(12) United States Patent
Bernett et al.

(10) Patent No.: US 10,851,178 B2
(45) Date of Patent: *Dec. 1, 2020

(54) HETERODIMERIC HUMAN IGG1 POLYPEPTIDES WITH ISOELECTRIC POINT MODIFICATIONS

(71) Applicant: Xencor, Inc., Monrovia, CA (US)

(72) Inventors: Matthew J. Bernett, Monrovia, CA (US); Gregory L. Moore, Monrovia, CA (US); John Desjarlais, Pasadena, CA (US); Rumana Rashid, Arcadia, CA (US)

(73) Assignee: Xencor, Inc., Monrovia, CA (US)

( * ) Notice: Subject to any disclaimer, the term of this patent is extended or adjusted under 35 U.S.C. 154(b) by 0 days.

This patent is subject to a terminal disclaimer.

(21) Appl. No.: 13/648,951

(22) Filed: Oct. 10, 2012

(65) Prior Publication Data

US 2013/0171095 A1 Jul. 4, 2013

Related U.S. Application Data

(63) Continuation-in-part of application No. 13/568,028, filed on Aug. 6, 2012, now abandoned.

(60) Provisional application No. 61/545,498, filed on Oct. 10, 2011, provisional application No. 61/598,686, filed on Feb. 14, 2012, provisional application No. 61/593,846, filed on Feb. 1, 2012.

(51) Int. Cl.
| | |
|---|---|
| *C07K 16/46* | (2006.01) |
| *C07K 16/28* | (2006.01) |
| *C07K 14/54* | (2006.01) |
| *C07K 14/535* | (2006.01) |
| *C07K 14/52* | (2006.01) |
| *C07K 14/525* | (2006.01) |
| *C07K 14/755* | (2006.01) |
| *C07K 14/745* | (2006.01) |
| *C07K 16/22* | (2006.01) |
| *C07K 14/705* | (2006.01) |
| *C07K 14/55* | (2006.01) |
| *C07K 16/00* | (2006.01) |
| *C07K 14/715* | (2006.01) |

(52) U.S. Cl.
CPC .......... *C07K 16/468* (2013.01); *C07K 14/521* (2013.01); *C07K 14/522* (2013.01); *C07K 14/523* (2013.01); *C07K 14/525* (2013.01); *C07K 14/535* (2013.01); *C07K 14/54* (2013.01); *C07K 14/5428* (2013.01); *C07K 14/5434* (2013.01); *C07K 14/55* (2013.01); *C07K 14/70521* (2013.01); *C07K 14/7151* (2013.01); *C07K 14/745* (2013.01); *C07K 14/755* (2013.01); *C07K 16/00* (2013.01); *C07K 16/22* (2013.01); *C07K 16/2803* (2013.01); *C07K 16/283* (2013.01); *C07K 16/2809* (2013.01); *C07K 16/2878* (2013.01); *C07K 2317/31* (2013.01); *C07K 2317/35* (2013.01); *C07K 2317/52* (2013.01); *C07K 2317/94* (2013.01); *C07K 2319/30* (2013.01)

(58) Field of Classification Search
None
See application file for complete search history.

(56) References Cited

U.S. PATENT DOCUMENTS

| | | |
|---|---|---|
| 3,691,016 A | 9/1972 | Patel |
| 3,773,919 A | 11/1973 | Boswell et al. |
| 3,969,287 A | 7/1976 | Jaworek |
| 4,169,888 A | 11/1979 | Hanka et al. |
| 4,179,337 A | 12/1979 | Davis et al. |
| 4,195,128 A | 3/1980 | Hildebrand et al. |
| 4,229,537 A | 10/1980 | Hodgins et al. |
| 4,247,642 A | 1/1981 | Hiorhara et al. |
| 4,256,746 A | 3/1981 | Miyashita et al. |
| 4,294,757 A | 10/1981 | Asai |
| 4,301,144 A | 11/1981 | Iwashita et al. |
| 4,307,016 A | 12/1981 | Asai et al. |
| 4,313,946 A | 2/1982 | Powell et al. |
| 4,315,929 A | 2/1982 | Freedman et al. |
| 4,364,935 A | 2/1982 | Kung et al. |
| 4,322,348 A | 3/1982 | Asai et al. |
| 4,330,440 A | 5/1982 | Ayers et al. |
| 4,331,598 A | 5/1982 | Hasegawa et al. |
| 4,361,650 A | 11/1982 | Asai |
| 4,362,663 A | 12/1982 | Kida et al. |
| 4,364,866 A | 12/1982 | Asai et al. |
| 4,371,533 A | 2/1983 | Akimoto et al. |
| 4,424,219 A | 1/1984 | Hashimoto et al. |

(Continued)

FOREIGN PATENT DOCUMENTS

| | | |
|---|---|---|
| EP | 0 425 2351 B1 | 9/1996 |
| EP | 1391213 | 8/2002 |

(Continued)

OTHER PUBLICATIONS

U.S. Appl. No. 12/631,508, filed Dec. 4, 2009, Chari.

(Continued)

*Primary Examiner* — Brian Gangle
*Assistant Examiner* — Andrea K McCollum
(74) *Attorney, Agent, or Firm* — Robin M. Silva; Louis T. Nguyen; Morgan, Lewis & Bockius, LLP

(57) ABSTRACT

The invention relates generally to compositions and methods for purifying the desired species from a mixture of desired heterodimer and contaminating homodimer immunoglobulin variants by modifying the isoelectric point(s) of the individual chains.

3 Claims, 212 Drawing Sheets

Specification includes a Sequence Listing.

(56) References Cited

U.S. PATENT DOCUMENTS

| | | |
|---|---|---|
| 4,450,254 A | 5/1984 | Isley et al. |
| 4,496,689 A | 1/1985 | Mitra |
| 4,640,835 A | 2/1987 | Shimizu et al. |
| 4,670,417 A | 6/1987 | Iwasaki et al. |
| 4,753,894 A | 6/1988 | Frankel et al. |
| 4,791,192 A | 12/1988 | Nakagawa et al. |
| 4,880,935 A | 11/1989 | Thorpe |
| 4,923,990 A | 5/1990 | Nakano et al. |
| 4,943,533 A | 7/1990 | Mendelsohn et al. |
| 4,970,198 A | 11/1990 | Lee et al. |
| 5,053,394 A | 10/1991 | Ellestad et al. |
| 5,070,092 A | 12/1991 | Kanda et al. |
| 5,084,468 A | 1/1992 | Saito et al. |
| 5,101,038 A | 3/1992 | Nakano et al. |
| 5,122,368 A | 6/1992 | Greenfield et al. |
| 5,187,186 A | 2/1993 | Kanda et al. |
| 5,208,020 A | 5/1993 | Chari et al. |
| 5,264,586 A | 11/1993 | Nicolaou et al. |
| 5,384,412 A | 1/1995 | Nicolaou et al. |
| 5,416,064 A | 5/1995 | Chari et al. |
| 5,475,092 A | 12/1995 | Chari et al. |
| 5,500,362 A | 3/1996 | Robinson et al. |
| 5,530,101 A | 6/1996 | Queen et al. |
| 5,541,087 A | 7/1996 | Lo et al. |
| 5,550,246 A | 8/1996 | Nicolaou et al. |
| 5,558,864 A | 9/1996 | Bendig et al. |
| 5,585,089 A | 12/1996 | Queen et al. |
| 5,585,097 A | 12/1996 | Bolt et al. |
| 5,585,499 A | 12/1996 | Chari et al. |
| 5,622,929 A | 4/1997 | Willner et al. |
| 5,635,483 A | 6/1997 | Pettit et al. |
| 5,641,780 A | 6/1997 | Amishiro et al. |
| 5,663,149 A | 9/1997 | Pettit et al. |
| 5,677,171 A | 10/1997 | Hudziak et al. |
| 5,693,761 A | 12/1997 | Queen et al. |
| 5,693,762 A | 12/1997 | Queen et al. |
| 5,703,080 A | 12/1997 | Nakakura et al. |
| 5,712,374 A | 1/1998 | Kuntsmann et al. |
| 5,714,586 A | 2/1998 | Kuntsmann et al. |
| 5,726,044 A | 3/1998 | Lo et al. |
| 5,731,168 A | 3/1998 | Carter et al. |
| 5,736,137 A | 4/1998 | Anderson et al. |
| 5,739,116 A | 4/1998 | Hamann et al. |
| 5,767,237 A | 6/1998 | Sakakibara et al. |
| 5,767,285 A | 6/1998 | Hamann et al. |
| 5,770,701 A | 6/1998 | McGahren et al. |
| 5,770,710 A | 6/1998 | McGahren et al. |
| 5,773,001 A | 6/1998 | Hamann et al. |
| 5,780,588 A | 7/1998 | Pettit et al. |
| 5,807,706 A | 9/1998 | Carter et al. |
| 5,821,333 A | 10/1998 | Carter et al. |
| 5,821,337 A | 10/1998 | Carter et al. |
| 5,824,805 A | 10/1998 | King et al. |
| 5,846,545 A | 12/1998 | Chari et al. |
| 5,859,205 A | 1/1999 | Adair et al. |
| 5,877,291 A | 3/1999 | Mezes et al. |
| 5,877,296 A | 3/1999 | Hamann et al. |
| 5,891,996 A | 4/1999 | Mateo de Acosta del Rio et al. |
| 5,892,020 A | 4/1999 | Mezes et al. |
| 5,945,311 A | 8/1999 | Lindhofer et al. |
| 5,968,509 A | 10/1999 | Gorman et al. |
| 6,054,297 A | 4/2000 | Carter et al. |
| 6,071,515 A | 6/2000 | Mezes et al. |
| 6,124,431 A | 9/2000 | Sakakibara et al. |
| 6,180,370 B1 | 1/2001 | Queen et al. |
| 6,214,345 B1 | 4/2001 | Firestone et al. |
| 6,235,883 B1 | 5/2001 | Jakobovits et al. |
| 6,329,507 B1 | 12/2001 | Mezes et al. |
| 6,407,213 B1 | 6/2002 | Carter et al. |
| 6,441,163 B1 | 8/2002 | Chari et al. |
| 6,506,883 B2 | 4/2003 | Mateo de Acosta del Rio et al. |
| 6,602,684 B1 | 8/2003 | Umana et al. |
| 6,632,927 B2 | 10/2003 | Adair et al. |
| 6,706,265 B1 | 3/2004 | Bolt et al. |
| 6,723,538 B2 | 4/2004 | Mack et al. |
| 6,884,869 B2 | 4/2005 | Senter et al. |
| 6,989,452 B2 | 1/2006 | Ng et al. |
| 7,087,600 B2 | 8/2006 | Ng et al. |
| 7,112,324 B1 | 9/2006 | Dorken et al. |
| 7,129,261 B2 | 10/2006 | Ng et al. |
| 7,276,497 B2 | 10/2007 | Chari et al. |
| 7,303,749 B1 | 12/2007 | Chari |
| 7,368,565 B2 | 5/2008 | Chari et al. |
| 7,498,302 B2 | 3/2009 | Ng et al. |
| 7,507,420 B2 | 3/2009 | Ng et al. |
| 7,517,903 B2 | 4/2009 | Chen et al. |
| 7,521,541 B2 | 4/2009 | Eigenbrot |
| 7,601,354 B2 | 10/2009 | Chari |
| 7,632,497 B2 * | 12/2009 | Stavenhagen ............... 424/133.1 |
| 7,642,228 B2 | 1/2010 | Carter et al. |
| 7,657,380 B2 | 2/2010 | Lazar et al. |
| 7,691,962 B2 | 4/2010 | Boyd et al. |
| 7,695,936 B2 | 4/2010 | Carter et al. |
| 7,696,338 B2 | 4/2010 | Neville, Jr. et al. |
| 7,728,114 B2 | 6/2010 | Mach et al. |
| 8,084,582 B2 | 12/2011 | Dahiyat et al. |
| 8,114,967 B2 | 2/2012 | Bhatt et al. |
| 8,188,231 B2 | 5/2012 | Lazar et al. |
| 8,216,805 B2 | 7/2012 | Carter et al. |
| 8,236,308 B2 | 8/2012 | Kischel et al. |
| 8,309,690 B2 | 11/2012 | Allan et al. |
| 8,409,568 B2 | 4/2013 | Gao et al. |
| 9,822,181 B2 | 11/2017 | Bonvini et al. |
| 9,856,327 B2 | 1/2018 | Bernett et al. |
| 10,106,624 B2 * | 10/2018 | Moore .................... C07K 19/00 |
| 2001/0035606 A1 | 11/2001 | Schoen |
| 2002/0103345 A1 | 8/2002 | Zhu |
| 2002/0131968 A1 | 9/2002 | Waldmann et al. |
| 2003/0003097 A1 | 1/2003 | Reff et al. |
| 2003/0017979 A1 | 1/2003 | Mack et al. |
| 2003/0040426 A1 | 2/2003 | Barrera et al. |
| 2003/0091561 A1 | 5/2003 | Van de Winekl |
| 2003/0015108 A1 | 8/2003 | Sappal et al. |
| 2003/0223999 A1 | 12/2003 | Lindhofer |
| 2004/0018191 A1 | 1/2004 | Wang |
| 2004/0071696 A1 | 4/2004 | Adams et al. |
| 2004/0162411 A1 | 8/2004 | Lanzavecchia |
| 2004/0242851 A1 | 12/2004 | Zhu |
| 2005/0114037 A1 | 5/2005 | Desjarlais et al. |
| 2005/0136050 A1 | 6/2005 | Kufer et al. |
| 2005/0176028 A1 | 8/2005 | Hofmeiser et al. |
| 2005/0191702 A1 | 9/2005 | Mack et al. |
| 2005/0238648 A1 | 10/2005 | Jacobs |
| 2005/0238649 A1 | 10/2005 | Doronina |
| 2006/0008883 A1 | 1/2006 | Lazar |
| 2006/0018897 A1 | 1/2006 | Lee et al. |
| 2006/0024317 A1 | 2/2006 | Boyd |
| 2006/0025472 A1 | 2/2006 | Basarab et al. |
| 2006/0073142 A1 | 4/2006 | Chan et al. |
| 2006/0074008 A1 | 4/2006 | Senter |
| 2006/0115481 A1 | 6/2006 | Lindhofer et al. |
| 2006/0134150 A1 | 6/2006 | Werling et al. |
| 2006/0235208 A1 | 10/2006 | Lazar |
| 2007/0071675 A1 | 3/2007 | Wu et al. |
| 2007/0105199 A1 | 5/2007 | Yan et al. |
| 2007/0123479 A1 | 5/2007 | Kufer et al. |
| 2007/0148170 A1 | 6/2007 | Desjarlais |
| 2007/0287170 A1 | 12/2007 | Davis et al. |
| 2008/0044413 A1 | 2/2008 | Hammond et al. |
| 2008/0050370 A1 | 2/2008 | Glaser et al. |
| 2008/0074693 A1 | 3/2008 | Hashimoto et al. |
| 2008/0138335 A1 | 6/2008 | Takahashi et al. |
| 2008/0213273 A1 | 9/2008 | Burge |
| 2009/0082213 A1 | 3/2009 | Horowitz et al. |
| 2009/0136485 A1 | 5/2009 | Chu et al. |
| 2009/0163699 A1 | 6/2009 | Chamberlain et al. |
| 2009/0214539 A1 | 8/2009 | Grosmaire et al. |
| 2009/0252683 A1 | 10/2009 | Kischel et al. |
| 2009/0263392 A1 * | 10/2009 | Igawa et al. ............... 424/136.1 |
| 2009/0274692 A1 | 11/2009 | Tan et al. |
| 2009/0311253 A1 | 12/2009 | Ghayur et al. |
| 2009/0317869 A1 | 12/2009 | Senter |
| 2010/0004431 A1 | 1/2010 | Bernett et al. |
| 2010/0150918 A1 | 6/2010 | Kufer et al. |

(56) References Cited

U.S. PATENT DOCUMENTS

| | | |
|---|---|---|
| 2010/0174053 A1 | 7/2010 | Johnson et al. |
| 2010/0178298 A1 | 7/2010 | Lindhofer |
| 2010/0183554 A1 | 7/2010 | Mach et al. |
| 2010/0226925 A1 | 9/2010 | Dillon et al. |
| 2010/0239582 A1 | 9/2010 | Humphreys et al. |
| 2010/0256339 A1 | 10/2010 | Bossenmaier et al. |
| 2010/0256340 A1 | 10/2010 | Brinkmann et al. |
| 2010/0298542 A1 | 11/2010 | Igawa et al. |
| 2010/0322933 A1 | 12/2010 | Lindhofer et al. |
| 2010/0330089 A1 | 12/2010 | Damle et al. |
| 2010/0331527 A1 | 12/2010 | Davis et al. |
| 2011/0054151 A1 | 3/2011 | Lazar et al. |
| 2011/0076275 A1 | 3/2011 | Senter |
| 2011/0177500 A1 | 7/2011 | Winther et al. |
| 2011/0189178 A1 | 8/2011 | Desjarlais et al. |
| 2011/0189209 A1 | 8/2011 | Neville, Jr. et al. |
| 2011/0201032 A1 | 8/2011 | Zeng et al. |
| 2011/0217302 A1 | 9/2011 | Odegard et al. |
| 2011/0262439 A1 | 10/2011 | Kufer et al. |
| 2011/0275787 A1 | 11/2011 | Kufer et al. |
| 2011/0293619 A1 | 12/2011 | Kufer et al. |
| 2012/0028304 A1 | 2/2012 | Dahiyat et al. |
| 2012/0034228 A1 | 2/2012 | Kufer et al. |
| 2012/0149876 A1 | 6/2012 | Von Kreudenstein et al. |
| 2012/0251531 A1 | 10/2012 | Baehner et al. |
| 2012/0251541 A1 | 10/2012 | Baurin et al. |
| 2013/0089541 A1 | 4/2013 | D'Angelo et al. |
| 2013/0095097 A1 | 4/2013 | Blakenship et al. |
| 2013/0101586 A1 | 4/2013 | Riegler et al. |
| 2013/0129723 A1 | 5/2013 | Blakenship et al. |
| 2013/0142793 A1 | 6/2013 | Ledbetter et al. |
| 2013/0195849 A1 | 8/2013 | Von Kreudenstein et al. |
| 2013/0267686 A1 | 10/2013 | Brinkmann |
| 2013/0336981 A1 | 12/2013 | de Kruif et al. |
| 2014/0072581 A1 | 3/2014 | Dixit et al. |
| 2014/0086916 A1 | 3/2014 | Zha |
| 2014/0212435 A1 | 7/2014 | Moore et al. |
| 2014/0212436 A1 | 7/2014 | Moore et al. |
| 2014/0249297 A1 | 9/2014 | Lazar et al. |
| 2014/0288275 A1 | 9/2014 | Moore et al. |
| 2014/0294759 A1 | 10/2014 | Chu et al. |
| 2014/0294823 A1 | 10/2014 | Moore et al. |
| 2014/0294833 A1 | 10/2014 | Desjarlais et al. |
| 2014/0294835 A1 | 10/2014 | Moore et al. |
| 2014/0294836 A1 | 10/2014 | Chu et al. |
| 2014/0302064 A1 | 10/2014 | Moore |
| 2014/0322217 A1 | 10/2014 | Moore et al. |
| 2014/0356381 A1 | 12/2014 | Moore et al. |
| 2014/0363426 A1 | 12/2014 | Moore et al. |
| 2014/0370013 A1 | 12/2014 | Desjarlais et al. |
| 2014/0370020 A1 | 12/2014 | Kuramochi et al. |
| 2014/0377269 A1 | 12/2014 | Mabry et al. |
| 2014/0377270 A1 | 12/2014 | Moore et al. |
| 2015/0071948 A1 | 3/2015 | Lazar et al. |
| 2015/0307629 A1 | 10/2015 | Bernett et al. |
| 2016/0060360 A1 | 3/2016 | Moore et al. |
| 2016/0068588 A1 | 3/2016 | Bernett et al. |
| 2016/0176969 A1 | 6/2016 | Bernett et al. |
| 2016/0215063 A1 | 7/2016 | Bernett et al. |
| 2016/0229924 A1 | 8/2016 | Bernett et al. |
| 2017/0020963 A1 | 1/2017 | Qu et al. |

FOREIGN PATENT DOCUMENTS

| | | |
|---|---|---|
| EP | 1752471 | 2/2007 |
| EP | 1829895 | 5/2007 |
| EP | 2009101 A1 | 12/2008 |
| EP | 2194066 A1 | 6/2010 |
| EP | 2194066 | 9/2010 |
| EP | 3252078 | 12/2017 |
| WO | WO 87/05330 | 9/1987 |
| WO | WO8705330 | 9/1987 |
| WO | WO 92/11018 | 7/1992 |
| WO | WO9211018 | 7/1992 |
| WO | WO 93/21232 | 10/1993 |
| WO | WO9321232 | 10/1993 |
| WO | WO 94/13804 | 5/1994 |
| WO | WO9413804 | 5/1994 |
| WO | WO 95/20045 | 1/1995 |
| WO | WO9520045 | 1/1995 |
| WO | WO 96/40210 | 6/1996 |
| WO | WO9640210 | 6/1996 |
| WO | WO96027011 | 9/1996 |
| WO | WO98050431 | 11/1998 |
| WO | WO99054440 | 10/1999 |
| WO | WO1999054440 | 10/1999 |
| WO | WO99066951 | 12/1999 |
| WO | WO 00/61739 A1 | 10/2000 |
| WO | WO2011005621 | 1/2001 |
| WO | WO 01/24763 A2 | 4/2001 |
| WO | WO 01/29246 A1 | 4/2001 |
| WO | WO 01/62931 A1 | 8/2001 |
| WO | WO 01/88138 | 11/2001 |
| WO | WO2001083525 | 11/2001 |
| WO | WO2001090192 | 11/2001 |
| WO | WO 02/16368 | 2/2002 |
| WO | WO 02/30954 A1 | 4/2002 |
| WO | WO 02/31140 A1 | 4/2002 |
| WO | WO 02/088172 A2 | 7/2002 |
| WO | WO2002062850 | 8/2002 |
| WO | WO 02/083180 | 10/2002 |
| WO | WO 02/098883 | 12/2002 |
| WO | WO 04/010957 | 2/2004 |
| WO | WO 04/043493 | 5/2004 |
| WO | WO 04/103272 | 12/2004 |
| WO | WO2004106383 | 12/2004 |
| WO | WO2005063816 | 7/2005 |
| WO | WO 05/112919 A2 | 12/2005 |
| WO | WO2005118635 | 12/2005 |
| WO | WO2006020258 | 2/2006 |
| WO | WO 06/034488 | 3/2006 |
| WO | WO2006036834 | 4/2006 |
| WO | WO2006072620 | 7/2006 |
| WO | WO 06/110476 A2 | 10/2006 |
| WO | WO2006106905 | 12/2006 |
| WO | WO2007005612 | 1/2007 |
| WO | WO 07/018431 A2 | 2/2007 |
| WO | WO2007033230 | 3/2007 |
| WO | WO2007042261 | 4/2007 |
| WO | WO2007046006 | 4/2007 |
| WO | WO2007047829 | 4/2007 |
| WO | WO 07/059404 A2 | 5/2007 |
| WO | WO2007062037 | 5/2007 |
| WO | WO2007084342 | 7/2007 |
| WO | WO 07/089149 A2 | 8/2007 |
| WO | WO2007093630 | 8/2007 |
| WO | WO2007098934 | 9/2007 |
| WO | WO 2007/114325 | 10/2007 |
| WO | WO2007110205 | 10/2007 |
| WO | WO2008003103 | 1/2008 |
| WO | WO2008003115 | 1/2008 |
| WO | WO2008003116 | 1/2008 |
| WO | WO2008119096 | 10/2008 |
| WO | WO2008124858 | 10/2008 |
| WO | WO 2008/150494 | 12/2008 |
| WO | WO2008145142 | 12/2008 |
| WO | WO2008150494 | 12/2008 |
| WO | WO2009000006 | 12/2008 |
| WO | WO 09/017394 A1 | 2/2009 |
| WO | WO2009017823 | 2/2009 |
| WO | WO2009030734 | 3/2009 |
| WO | WO2009032782 | 3/2009 |
| WO | WO 2009/041613 | 4/2009 |
| WO | WO2013180201 | 6/2009 |
| WO | WO2009086320 | 7/2009 |
| WO | WO2009089004 | 7/2009 |
| WO | WO2009106096 | 9/2009 |
| WO | WO2009106321 | 9/2009 |
| WO | WO 2010/033736 | 3/2010 |
| WO | WO2010033736 | 3/2010 |
| WO | WO2010034441 | 4/2010 |
| WO | WO2010037835 | 4/2010 |
| WO | WO2010042904 | 4/2010 |
| WO | WO 10/062171 A2 | 6/2010 |

(56) References Cited

FOREIGN PATENT DOCUMENTS

| WO | WO2010085682 | 7/2010 |
|---|---|---|
| WO | WO2010/106180 | 9/2010 |
| WO | WO2010115589 | 10/2010 |
| WO | WO2010119119 | 10/2010 |
| WO | WO2011133886 | 10/2010 |
| WO | WO2010151792 | 12/2010 |
| WO | WO2010151808 | 12/2010 |
| WO | WO2011028952 | 3/2011 |
| WO | WO2011036183 | 3/2011 |
| WO | WO2011066342 | 3/2011 |
| WO | WO2011063348 | 5/2011 |
| WO | WO2011066501 | 6/2011 |
| WO | WO2011131746 | 10/2011 |
| WO | WO2011143545 | 11/2011 |
| WO | WO 12/016227 A2 | 2/2012 |
| WO | WO2012018687 | 2/2012 |
| WO | WO2012032080 | 3/2012 |
| WO | WO 12/058768 A1 | 5/2012 |
| WO | WO2012058768 | 5/2012 |
| WO | WO2012062596 | 5/2012 |
| WO | WO2012107417 | 8/2012 |
| WO | WO2012116453 | 9/2012 |
| WO | WO2012125495 | 9/2012 |
| WO | WO2012125850 | 9/2012 |
| WO | WO2012131555 | 10/2012 |
| WO | WO2012146394 | 11/2012 |
| WO | WO2012146628 | 11/2012 |
| WO | WO2012162067 | 11/2012 |
| WO | WO2013006544 | 1/2013 |
| WO | WO2013016714 | 1/2013 |
| WO | WO2013022855 | 2/2013 |
| WO | WO2013026833 | 2/2013 |
| WO | WO2013033008 | 3/2013 |
| WO | WO2013055809 | 4/2013 |
| WO | WO2013063702 | 5/2013 |
| WO | WO2013096828 | 6/2013 |
| WO | WO 2013/125667 | 8/2013 |
| WO | WO2014004586 | 1/2014 |
| WO | WO2014012085 | 1/2014 |
| WO | WO2014047231 | 3/2014 |
| WO | WO2014056783 | 4/2014 |
| WO | WO2014079000 | 5/2014 |
| WO | WO2014110601 | 7/2014 |
| WO | WO2014113510 | 7/2014 |
| WO | WO2014145806 | 9/2014 |
| WO | WO2014145907 | 9/2014 |
| WO | WO2014164553 | 10/2014 |
| WO | WO2014209804 | 12/2014 |
| WO | WO2015018528 | 2/2015 |
| WO | WO2015026892 | 2/2015 |
| WO | WO2015095392 | 6/2015 |
| WO | WO2015095410 | 6/2015 |
| WO | WO2015103072 | 7/2015 |
| WO | WO2015143079 | 9/2015 |
| WO | WO2015149077 | 10/2015 |
| WO | WO2015184207 | 12/2015 |
| WO | WO2016014984 | 1/2016 |
| WO | WO2016086186 | 6/2016 |
| WO | WO2016086189 | 6/2016 |
| WO | WO2016086196 | 6/2016 |
| WO | WO2016105450 | 6/2016 |
| WO | WO2016141387 | 9/2016 |
| WO | WO2016182751 | 11/2016 |
| WO | WO2017112775 | 6/2017 |
| WO | WO2017210485 | 12/2017 |

OTHER PUBLICATIONS

Aplin et al., Preparation, properties, and applications of carbohydrate conjugates of proteins and lipids, 1981, CRC Crit. Rev. Biochem., pp. 259-306.
Ashkenazi et al., Immunoadhesins as research tools and therapeutic agents, 1997, Curr Opin Immunol, 9:195-200.
Atwell et al., Stable Heterodimers from Remodeling the Domain Interface of a Homodimer using a Phage Display Library, 1997, J. Mol. Biol., 270-26-35.
Baca et al., Antibody humanization using monovalent phage display, 1997, J. Biol. Chem. 272(16):10678-10684.
Barbas, et al. In vitro evolution of a neutralizing human antibody to human immunodeficiency virus type 1 to enhance affinity and broaden strain cross-reactivity, 1994, Proc. Nat. Acad. Sci, USA 91:3809-3813.
Biochemica, Your apoptosis specialist, 1999, No. 2, pp. 34-37 (Roche Molecular Biochemicals).
Bird et al., Single-chain antigen-binding proteins, 1988, Science 242:423-426.
Bowles et al., CD16 polymorphisms and NK activation induced by monoclonal antibody-coated target cells, 2005, JIM, 304:88-99.
Bjellqvist et al., Reference points for comparisons of two-dimensional maps of proteins from different human cell types defined in a pH scale where isoelectric points correlate with polypeptide compositions, 1994, Electrophoresis 15:529-539.
Carter et al., Humanization of an anti-p185HER2 antibody for human cancer therapy, 1992, Proc Natl Acad Sci USA 89:4285-9.
Carter et al., Antibody-drug conjugates for cancer therapy, 2008, Cancer J. 14(3):154-169.
Chames et al., Bispecific antibodies for cancer therapy—the light at the end of the tunnel?, 2009, mAbs, 1[6]:1-9.
Chamow et al., Immunoadhesins: principles and applications, 1996, Trends Biotechnol 1996, 14:52-60.
Chari et al., Immunoconjugates containing novel maytansinoids: promising anticancer drugs, 1992, Cancer Research 52: 127-131.
Chatenoud et al., CD3-specific antibodies: a portal to the treatment of autoimmunity, Nature Immun., 2007, 7:622-632.
Chothia et al., Canonical structures for the hypervariable regions of immunoglobulins, 1987, J. Mol. Biol. 196:901-917.
Dall' Acqua et al., Increasing the Affinity of a Human IgG1 for the Neonatal Fc Receptor: Biological Consequence[1], 2002, J. Immunol. 169:5171-5180.
Davies et al., Expression of GnTIII in recombinant anti-CD20 CHO production cell line: expression of antibodies with altered glycoforms leads to an increase in ADCC through higher affinity for FCγRIII, 2001, Biotechnol Bioeng 74:288-294.
Davis et al., Fc Receptor homologs: newest members of a remarkably diverse Fc receptor gene family, Immunol. Reviews, 2002, 190:123-126.
De Pascalis et al., Grafting of "abbreviated" complementarity-determining regions containing specificity-determining residues essential for ligand contact to engineer a less immunogenic humanized monoclonal antibody, 2002, J. Immunol. 169:3076-3084.
Doronina , Development of potent monoclonal antibody auristatin conjugates for cancer therapy, 2003, Nat Biotechnol 21(7):778-784.
Dubowchik et al., Receptor-mediated and enzyme-dependent targeting of cytotoxic anticancer drugs, 1999, Pharm. Therapeutics 83:67-123.
Ducry et al., Antibody-drug conjugates: linking cytotoxic payloads to monoclonal antibodies, 2010, Bioconjugate Chem. 21:5-13.
Duksin et al., Relationship of the structure and biological activity of the natural homologues of tunicamycin, 1982, J. Biol. Chem. 257:3105.
Edge et al., Deglycosylation of glycoproteins by trifluoromethanesulfonic acid, 1981, Anal. Biochem. 118:131.
Fraker et al., Crystal structure of peptide cyclo-(D-VAL-L-PRO-L-VAL-D-PRO)$_3$, 1978, Biochem. Biophys. Res. Commun. 80(4):849-57.
Ghetie et al., Multiple roles for the major histocompatibility complex Class I-related receptor FcRn, 2000, Annu Rev Immunol 18:739-766.
Ghetie et al., FcRn: the MHC class I-related receptor that is more important than an IgG transporter, 1997, Immunol Today 18(12):592-598.
Gorman et al., Reshaping a therapeutic CD4 antibody, 1991, Proc. Natl. Acad. Sci. USA 88:4181-4185.
Gunasekaran et al., Enhancing Antibody Fc Heterodimer Formation through Electrostatic Steering Effects, 2010, JBC. 285(25):19637-19646.

(56) References Cited

OTHER PUBLICATIONS

Hakimuddin et al., A chemical method for the deglycosylation of proteins, 1987, Arch. Biochem. Biophys. 259:52.

Hawkins et al, Selection of phage antibodies by binding affinity mimicking affinity maturation, 1992, J. Mol. Biol. 226:889-896.

He et al., Humanization and pharmacokinetics of a monoclonal antibody with specificity for both E- and P-selectin, 1998, J. Immunol. 160:1029-1035.

Heyman, Feedback regulation by IgG antibodies, 2003, Immunol Lett 88:157-161.

Hinman et al., Preparation and characterization of monoclonal antibody conjugates of the calicheamicins: a novel and potent family of antitumor antibodies, 1993 Cancer Res. 53:3336-3342.

Holliger et al., Engineering bispecific antibodies, 1993, Current Opinion Biotechnol. 4:446-449.

Holliger et al., "Diabodies": Small Bivalent and bispecific antibody fragments, 1993, Proc. Natl. Acad. Sci. U.S.A. 90:6444-6448.

Holliger et al., Engineered antibody fragments and the rise of single domains, 2005, Nat Bio 23[9]:1126-1136.

Hu et al., Minibody: A novel engineered anti-carcinoembryonic antigen antibody fragment (single-chain Fv-$C_H3$) which exhibits rapid, high-level targeting of xenografts, 1996, Cancer Res. 56:3055-3061.

Huston et al., Protein engineering antibody binding sites: recovery of specific activity in an anti-digoxin single-chain Fv analogue produced in *Escherichia coli,* 1988, Proc. Natl. Acad. Sci. U.S.A. 85:5879-5883.

Igawa et al., Reduced elimination of IgG antibodies by engineering the variable region, 2010, PEDS. 23(5): 385-392.

Jackson et al., In vitro antibody maturation, 1995, J. Immunol. 154(7):3310-9.

Jefferis et al., Interaction sites on human IgG-Fc for FcγR: current models, 2002, Immunol Lett 82:57-65.

Johnson et al., Anti-tumor activity of CC49-doxorubicin immunoconguates, 1995, Anticancer Res. 15:1387-93.

Jones et al., Replacing the complementarity-determining regions in a human antibody with those from a mouse, 1986, Nature 321:522-525.

Jungbluth et al., A monoclonal antibody recognizing human cancers with amplification/overexpression of the human epidermal growth factor receptor, 2003, Proc Natl Acad Sci U S A. 100(2):639-44.

Kettleborough et al., Humanization of a mouse monoclonal antibody by CDR-grafting: the importance of framework residues on loop conformation, 1991, Protein Eng. 4(7):773-83.

Klein et al., Progression of metastatic human prostate cancer to androgen independence in immunodeficient SDIC mice, 1997, Nature Medicine 3: 402-408.

Krauss et al., Specificity grafting of human antibody frameworks selected from a phage display library: generation of a highly stable humanized anti-CD22 single-chain Fv fragment, 2003, Protein Engineering 16(10):753-759.

Kuhns et al., Deconstructing the Form and Function of the TCR/CD3 Complex, Immunity, 2006 24(2):133-139.

Lau et al., Conjugation of Doxorubicin to monoclonal anti-carcinoembryonic antigen antibody via novel thiol-directed cross-linking regents, 1995, Bioorg-Med-Chem. 3(10):1299-1304.

Lau et al., Novel doxorubicin-monoclonal anti-carcinoembryonic antigen antibody immunoconjugate activity in vitro, 1995, Bioorg-Med-Chem. 3(10):1305-12.

Liu et al., Eradication of large colon tumor xenografts by targeted delivery of maytansinoids, 1996 Proc. Natl. Acad. Sci. USA 93:8618-8623.

Lode et al., Targeted therapy with a novel enediyene antibiotic calicheamicins $o^I_1$ effectively suppress growth and dissemination of liver metastases in a syngeneic model of murine neuroblastoma, 1998, Cancer Res. 58:2928.

Lu et al., A Fully Human Recombinant IgG-like Bispecific antibody to Both the Epidermal Growth Factor Receptor and the Insulin-like Growth Factor for Enhanced Antitumor Activity, JBC 280(20):19665-19672.

Mandler et al., Synthesis and evaluation of antiproliferative activity of a geldanaymcin-herceptin™ immunoconjugates, 2000, Bioorganic & Med. Chem. Letters 10:1025-1028.

Mandler et al., Modifications in synthesis strategy improve the yield and efficacy of geldanamycin-herceptin immunoconjugates, 2002, Bioconjugate Chem. 13:786-791).

Mandler et al., Immunoconjugates of geldanamycin and anti-HER2 Monoclonal antibodies: antiproliferative activity on human breast carcinoma cell lines, 2000, J. Nat. Cancer Inst. 92(19):1573-1581.

Marks et al., By-passing immunization: building high affinity human antibodies by chain shuffling, 1992, Biotechnology 10:779-783.

Mateo et al, Humanization of a mouse nonoclonal antibody that blocks the epidermal growth factor receptor: recovery of antagonistic activity, 1997, Immunotechnology, 3(1):71-81.

Maynard et al., Antibody Engineering, 2000, Annu Rev Biomed Eng 2:339-376.

Merchant et al., An efficient route to human bispecific IgG, 1998, Nature Bio 16:677-691.

Michaelson et al., Anti-tumor activity of stability-engineered IgG-like bispecific antibodies targeting TRAIL-R2 and LTβR2009, mAbs 1(2):128-141.

Milstein et al., Hybrid hybridomas and their use in immunohistochemistry, 1983, Nature, 305:537-540.

Modjtahedi et al, Phase I trial and tumour localization of the anti-EGFR monoclonal antibody ICR62 in head and neck or lung cancer, 1996, Br J Cancer, 73(2):228-35.

Modjtahedi et al, Targeting of cells expressing wild-type EGFR and type-III mutant EGFR (EGFRVIII) by anti-EGFR MaB ICR62: a two-pronged attack for tumor therapy, 2003, Int J Cancer, 105(2):273-80.

Modjtahedi et al., The human EGF receptor as a target for cancer therapy: six new rat mAbs against the receptor on the breast carcinoma MDA-MB 468, 1993, Br J Cancer. 1993, 67(2):247-53.

Modjtahedi et al., Antitumor activity of combinations of antibodies directed against different epitopes on the extracellular domain of the human EGF receptor, 1993, J. Cell Biophys. 1993, 22(1-3):129-46.

Morea et al., Antibody structure, prediction and redesign, 1997, Biophysical Chem, 68:9-16.

Morea et al., Antibody Modeling: Implications for Engineering and Design, 2000, 20:267-279.

Mosmann, Rapid colorimetric assay for cellular growth and survival: application to proliferation and cytotoxicity assays, 1983, J. Immunol. Methods 65:55-63.

Murthy et al., Binding of an antagonistic monoclonal antibody to an intact and fragmented EGF-receptor polypeptide, 1987, Arch Biochem Biophys. 252(2):549-60.

Neville et al., Enhancement of immunotoxin efficacy by acid-cleavable cross-ling agents utilizing diphtheria toxin and toxin mutants, 1989, Biol. Chem. 264:14653-14661.

O'Connor et al., Humanization of an antibody against human protein C and calcium-dependence involving framework residues, 1998, Protein Eng 11:321-8.

Page et al., 1993, International. Journal of Oncology 3:473-476.

Perruche et al., Lethal Effect of CD3-Specific Antibody in Mice Deficient in TGF-1 by Uncontrolled Flu-Like Syndrome12009, J. Immunol 183(2):953-61.

Petkova et al., Enhanced half-life of genetically engineered human IgG1 antibodies in a humanized FcRn mouse model: potential application in humorally mediated autoimmune disease, 2006, Int Immunol 18(12):1759-69.

Pettit et al., The Absolute configuration and synthysis of natural (−)-Dolastatin $10^1$, 1989, J. Am. Chem. Soc. 111:5463-5465.

Pettit et al., Dolastatins 24. Synthesis of (−)-dolastatin 10.I X-ray molecular structure of N,N-dimethylvalyl-valyl-dolaisoleuine tert-butyl ester, 1996, J. Chem. Soc. Perkin Trans. 1 5:859-863.

Pettit et al., Antineoplastic agents 365. Dolastatin 10 SAR probes, 1998, Anti-Cancer Drug Design 13:243-277.

Pettit et al., Specific activities of dolastatin 10 and peptide derivatives against Cryptococcus neoformans, 1998, Antimicrob. Agents Chemother. 42(11):2961-2965.

Pettit, et al., The dolastatins; 18: Sterospecific synthesis of dolaproine1, 1996, Synthesis 719-725.

(56) References Cited

OTHER PUBLICATIONS

Piazza et al., Antineoplastic drugs sulindac sulfide and sulfone inhibit cell growth by inducing apoptosis, 1995, Cancer Research 55:3110-16.
Presta et al., Humanization of an anti-vascular endothelial growth factor monoclonal antibody for the therapy of solid tumors and other disorders, 1997, Cancer Res.57(20):4593-9.
Queen et al., A humanized antibody that binds to the interleukin 2 receptor, 1989, Proc Natl Acad Sci, USA 86:10029-33.
Rader et al., A phage display approach for rapid antibody humanization: designed combinatorial V gene libraries, 1998, Proc. Natl. Acad. Sci. USA 95:8910-8915.
Raghavan et al., Fc receptors and their interactions with immunoglobulins, 1996, Annu Rev Cell Dev Biol 12:181-220.
Reiter et al., Engineering antibody Fv fragments for cancer detection and therapy: disulfide-stabilized Fv fragment, 1996, Nature Biotech. 14:1239-1245.
Ridgway et al., 'Knobs-into-holes' engineering of antibody $C^{H}3$ domains for heavy chain heterodimerization, 1996 Pro Eng, 9(7):617-621.
Riechmann et al., Reshaping human antibodies for therapy, 1988, Nature 332:323-329.
Rodeck et al., Interactions between growth factor receptors and corresponding monoclonal antibodies in human tumors, 1987, J Cell Biochem. 35(4):315-20.
Roguska et al., Humanization of murine monoclonal antibodies through variable domain resurfacing, 1994, Proc. Natl. Acad. Sci. USA 91:969-973.
Roque et al., Antibodies and genetically engineered related molecules: production and purification, 2004, Biotechnol. Prog. 20:639-654.
Rosok et al., A combinatorial library strategy for the rapid humanization of anticarcinoma BR 96 Fab, 1996, J. Biol. Chem. 271(37): 22611-22618.
Schroder et al., The Peptides, vol. pp. 76-136, 1965, Academic Press.
Senter, Potent antibody drug conjugates for cancer therapy, 2009, Current Opin. Chem. Biol. 13:235-244.
Senter et al, Proceedings of the American Association for Cancer Research, 2004, vol. 45, Abstract No. 623.
Shen et al., Single Variable Domain-IgG Fusion A Novel Recombinant Approach to Fc Domain-Containing Bispecific Antibodies, 2006, J Biol Chem 281(16):10706-10714.
Shields et al., Lack of fucose on human IgG1 N-linked oligosaccharide improves binding to human FcγRIII and antibody-dependent cellular toxicity, 2002, J Biol Chem 277:26733-26740.
Shier et al., Identification of functional and structural amino-acid residues by parsimonious mutagenesis, 1995, Gene 169:147-155.
Shinkawa et al., The absence of fucose but not the presence of galactose or bisecting N-acetylglucosamine of human IgG1 complex-type oligosaccharides shows the critical role of enhancing antibody-dependent cellular cytotoxicity, 2003, J Biol Chem 278:3466-3473.
Simon et al., Peptoides: a modular approach to drug discovery, 1992, PNAS 89(20):9367.
Skehan et al., Identification of functional and structural amino-acid residues by parsimonious mutagenesis, 1990, J. Natl. Cancer Inst. 82(13):1107-12.
Smith et al., FcγRIIB in autoimmunity and infection: evolutionary and therapeutic implications2010, Nature, 10:328-343.
Tan et al., "Superhumanized" antibodies: reduction of immunogenic potential by complementarity-determining region grafting with human germline sequences: application to an anti-CD28, 2002, J. Immunol. 169:1119-1125.
Thorpe et al., New coupling agents for the synthesis of immunotoxins containing a hindered disulfide bond with improved stability in Vivo, 1987, Cancer Res. 47:5924-5931.
Thotakura et al., Enzymatic deglycosylating of glycoproteins, 1987, Meth. Enzymol. 138:350.
Tomlinson et. al., Methods for generating multivalent and bispecific antibody fragments, 2000, Methods Enzymol. 326:461-479.
Tsurushita et al., Humanization of monoclonal antibodies, 2004, Molecular Biology of B Cells 533-545.
Umaña et al., Engineered glycoforms of an antineuro-blastoma IgG1 with optimized antibody-dependent cellular cytotoxic activity, 1999, Nat Biotechnol 17:176-180.
Verhoeyen et al., Reshaping human antibodies: grafting an antilysozyme activity, 1988, Science, 239:1534-1536.
Wawrzynczak et al., Methods for preparing immunotoxins: Effect of the linkage on activity and stability. In Immunoconjugates. Antibody Conjugates in Radio imaging and Therapy of Cancer. (C.-W. Vogel, editor). New York, Oxford University Press, pp. 28-55.
Woyke et al., In vitro activities and postantifungal effects of the potent dolastation 10 derivative auristatin PHE, 2001, Antimicrob. Agents and Chemother. 45(12):3580-3584.
Wu et al., Humanization of a murine monoclonal antibody by simultaneous optimization of framework and CDR residues, 1999, J. Mol. Biol. 294:151-162.
Wu et al., Simultaneous targeting of multiple disease mediators by a dual-variable-domain immunoglobulin, 2007, Nat Bio 25(11):1290-1297.
Yelton et al., Affinity maturation of the BR96 anti-carcinoma antibody by codon-based mutagenesis, 1995, J. Immunol. 155:1994-2004.
Yu et al., The biosynthetic gene cluster of the maytansinoids antitumor agent ansamitocin from actinosynnema pretiosum, 2002, PNAS 99:7968-7973.
Zuo et al., An efficient route to the production of an IgG-like bispecific antibody, 2000, Protein Eng. 13(5):361-367.
Duke, et al., Measurement of apoptosis and other forms of cell death, 2004, Curr protocols immunol. 3.17.1-3.17.16.
Moore et al., A novel bispecific antibody format enables simultaneous bivalent and monovalent co-engagement of distinct target antigens., MAbs. Nov.-Dec. 2011; 3(6): 546-557. Published online Nov. 1, 2011. doi: 10.4161/mabs.3.6.18123.
Klein et al., Progress in overcoming the chain association issue in bispecific heterodimeric IgG antibodies., MAbs. Nov.-Dec. 2012;4(6):653-63. doi: 10.4161/mabs.21379. Epub Aug. 27, 2012.
Ganesan et al., FcγRIIb on Liver Sinusoidal Endothelium Clears Small Immune Complexes., The Journal of Immunology, Nov. 15, 2012, vol. 189 No. 10 4981-4988.
Cemerski et al., Suppression of mast cell degranulation through a dual-targeting tandem IgE-IgG Fc domain biologic engineered to bind with high affinity to FcγRIIb., Immunol Lett. Mar. 30, 2012;143(1):34-43. doi: 10.1016/j.imlet.2012.01.008. Epub Jan. 25, 2012.
Yeung et al., Engineering human IgG1 affinity to human neonatal Fc receptor: impact of affinity improvement on pharmacokinetics in primates., J Immunol. Jun. 15, 2009;182(12):7663-71. doi: 10.4049/jimmunol.0804182.
Abbott Laboratories, Strategies and Current Approaches for Improving Drug-Like-Properties During Biologics Drug Candidate Selection, AAPS Webinar—Nov. 10, 2011.
Adams, et al., Avidity-Mediated Enhancement of In vivo Tumor Targeting by Single-Chain Fv Dimers, Clin Cancer Res, 2006, vol. 12(5), pp. 1599-1605, doi:10.1158/1078-0432.CCR-05-2217.
Alberola-Ila et al., Stimulation Through the TCR/CD3 Complex Up-Regulates the CD2 Srface Expression on Human T Lymphocytes, Feb. 15, 1991.
Alibaud et al., A New Monoclonal Anti-CD3? Antibody Reactive on Paraffin Sections, Journal of Histochemistry & Cytochemistry, 2000, vol. 48, p. 1609.
An, et al., IgG2m4, an engineered antibody isotype with reduced Fc function, mAbs, 2009, vol. 1, Issue 6, pp. 572-579, www.landesbioscience.com/journals/mabs/article/10185.
Arnett, et al., Crystal structure of a human CD3-ε/δ dimer in complex with a UCHT1 single-chain antibody fragment, PNAS, 2004, vol. 101, No. 46, pp. 16268-16273.
Asano, et al., Cytotoxic enhancement of a bispecific diabody (Db) by format conversion to tandem single-chain variable fragment (taFv): The Case of the hEx3 Diabody, JBC Papers in Press, 2010, http://www.jbc.org/cgi/doi/10.1074/jbc.M110.172957.
Asano, et al., Highly Effective Recombinant Format of a Humanized IgG-like Bispecific Antibody for Cancer Immunotherapy with

(56) References Cited

OTHER PUBLICATIONS

Retargeting of Lymphocytes to Tumor Cells, The Journal of Biological Chemistry, 2007, vol. 282, No. 38, pp. 27659-27665.
Atwell, et al., Stable Heterodimers from Remodeling the Domain Interface of a Homodimer using a Phage Display Library, J. Mol. Biol., 1997, vol. 270, pp. 26-35.
Baeuerle, et al., Response to Letter, "Correct TandAb protein," Molecular Immunology, 2007, vol. 44, p. 3084.
Baeuerle, et al., Review—Bispecific T-Cell Engaging Antibodies for Cancer Therapy, Cancer Res, 2009, vol. 69: (12), pp. 4941-4944.
Bargou et al., Tumor Regression in Cancer Patients by Very Low Doses of a T Cell-Engaging Antibody, Science, 2008, vol. 321, pp. 974-977.
Bhatt, Sea Lane—DDD presentation, "Surrobodies™ A Novel Approach to Bispecifics . . . ," Aug. 8, 2012.
Bibollet-Ruche et al., The Quality of Chimpanzee T-Cell Activation and Simian Immunodeficiency Virus/Human Immunodeficiency Virus Susceptibility Achieved via Antibody-Mediated T-Cell Receptor/CD3 Stimulation is a Function of the Anti-CD3 Antibody Isotype, Jul. 30, 2008.
Bluemel, et al., Epitope distance to the target cell membrane and antigen size determine the potency of T cell-mediated lysis by BiTE antibodies specific for a large melanoma surface antigen, Cancer Immunol Immunother, 2010, vol. 59(8), pp. 1197-1209.
Borras, et al., Generic Approach for the Generation of Stable Humanized Single-chain Fv Fragments from Rabbit Monoclonal Antibodies, The Journal of Biological Chemistry, 2010, vol. 285, No. 12, pp. 9054-9066.
Brandl, et al., Bispecific antibody fragments with CD20 3 CD28 specificity allow effective autologous and allogeneic T-cell activation against malignant cells in peripheral blood and bone marrow cultures from patients with B-cell lineage leukemia and lymphoma, Experimental Hematology, 1999, vol. 27, pp. 1264-1270.
Brinkmann, et al., A recombinant immunotoxin containing a disulfide-stabilized Fv fragment, Proc. Natl. Acad. Sci. USA, 1993, vol. 90, pp. 7538-7542.
Carpenter, et al., Non-Fc Receptor-Binding Humanized Anti-CD3 Antibodies Induce Apoptosis of Activated Human T Cells, J. Immunol., 2000, vol. 165, No. 11, pp. 6205-6213.
Castoldi, et al., Molecular characterization of novel trispecific ErbB-cMet-IGF1R antibodies and their antigen-binding properties, Protein Engineering, Design & Selection, 2012, vol. 25, No. 10, pp. 551-559.
Chames et al., Bispecific antibodies for cancer therapy—The light at the end of the tunnel?, mAbs, 2009, vol. 1, Issue 6, pp. 1-9.
Chelius, et al., Structural and functional characterization of the trifunctional antibody catumaxomab, mAbs, 2010, vol. 2, Issue 3, pp. 309-319.
Chothia, et al., Structural Determinants in the Sequences of Immunoglobulin Variable Domain, J. Mol. Biol., 1998, vol. 278, pp. 457-479.
Conrath, et al., Antigen Binding and Solubility Effects upon the Veneering of a Camel VHH in Framework-2 to Mimic a VH, J. Mol. Biol. , 2005, vol. 350, pp. 112-125.
Cuesta, et al., Multivalent antibodies: when design surpasses evolution, Trends in Biotechnology, 2010, vol. 28, No. 7, pp. 355-362, doi:10.1016/j.tibtech.2010.03.007.
d'Argouges, et al., Combination of rituximab with blinatumomab (MT103/MEDI-538), a T cell-engaging CD19-/CD3-bispecific antibody, for highly efficient lysis of human B lymphoma cells, Leukemia Research, 2009, vol. 33, pp. 465-473.
Davila, et al., Efficacy and Toxicity Management of 19-28z CAR T Cell Therapy in B Cell Acute Lymphoblastic Leukemia, Sci. Transl. Med., 2014, vol. 6, Issue 224, pp. 1-10, 224ra25.
Davis, et al., SEEDbodies: fusion proteins based on strand-exchange engineered domain (SEED) $C_H3$ heterodimers in an Fc analogue platform for asymmetric binders or immunofusions and bispecific antibodies, Protein Engineering, Design & Selection, 2010, vol. 23, No. 4 pp. 195-202.

Demarest et al., Antibody therapeutics, antibody engineering, and the merits of protein stability, Current Opinin in Drug Discovery & Development, 2008 11(5): 675-587, Sep. 11, 2008.
Deyev, et al., Multivalency: the hallmark of antibodies used for optimization of tumor targeting by design, BioEssays, 2008, vol. 30, pp. 904-918.
DiGiammarino et al., Ligand association rates to the inner-variable-domain of a dual-variable-domain immunoglobulin are significantly impacted by linker design, mAbs3:5, 1-8; Sep.-Oct.; 3(5):487-94, Landes Bioscience, Sep. 1, 2011.
Dixon, et al., Activation of Human T Lymphocytes by Crosslinking of Anti-CD3 Monoclonal Antibodies, Journal of Leukocyte Biology, 1989, vol. 46, pp. 214-220.
Dong et al., A stable IgG-like bispecific antibody targeting the epidermal growth factor receptor and the type I insulin-like growth factor receptor demonstrates superior anti-tumor activity, mAbs 3:3, May-Jun. 2011: 273-288, May 1, 2011.
Dreier, et al., Extremely Potent, Rapid and Costimulation-Independent Cytotoxic T-cell Response Against Lymphoma Cells Catalyzed by a Single-Chain Bispecific Antibody, Int. J. Cancer, 2002, vol. 100, pp. 690-697.
Dreier, et al., T Cell Costimulus-Independent and Very Efficacious Inhibition of Tumor Growth in Mice Bearing Subcutaneous or Leukemic Human B Cell Lymphoma Xenografts by a CD19-/CD3-Bispecific Single-Chain Antibody Construct, The Journal of Immunology, 2003, vol. 170, pp. 4397-4402.
Dudgeon, et al., General strategy for the generation of human antibody variable domains with increased aggregation resistance, PNAS Early Edition, 2012, pp. 10879-10884, www.pnas.org/cgi/doi/10.1073/pnas.1202866109 & Supporting Information.
Duval, et al., A Bispecific Antibody Composed of a Nonneutralizing Antibody to the gp41 Immunodominant Region and an Anti-CD89 Antibody Directs Broad Human Immunodeficiency Virus Destruction by Neutrophils, Journal of Virology, 2008, pp. 4671-4674, doi:10.1128/JVI.02499-07.
Elliott, et al., Antiparallel Conformation of Knob and Hole Aglycosylated Half-Antibody Homodimers is Mediated by a CH2—CH3 Hydrophobic Interaction, Journal of Molecular Biology, 2014, vol. 426, Issue 9, pp. 1947-1957.
Feldmann et al., Novel Humanized and Highly Efficient Bispecific Antibodies Mediate Killing of Prostate Stem Cell Antigen-Expressing Tumor Cells by CD8+ and CD4+ T cells, Aug. 8, 2012.
Feldmann et al., Retargeting of T Cells to Prostate Stem Cell Antigen Expressing Tumor Cells: Comparison of Different Antibody Formats, Dec. 28, 2010.
Fernandes, et al., T Cell Receptors are Structures Capable of Initiating Signaling in the Absence of Large Conformational Rearrangements, The Journal of Biological Chemistry, 2012, vol. 287, No. 16, pp. 13324-13335.
Foreman, et al., ErbB3 Inhibitory Surrobodies Inhibit Tumor Cell Proliferation In Vitro and In Vivo, Mol Cancer Ther, 2012, vol. 11(7) , pp. 1411-1420.
Foreman, et al., PEGS poster, "ErbB3 Inhibitory Surrobodies Inhibit Tumor Cell Proliferation In Vitro and In Vivo," 2012.
Francois, et al., Construction of a Bispecific Antibody Reacting with the α- and β-Chains of the Human IL-2 Receptor, The Journal of Immunology, May 15, 1993, vol. 150, No. 10, pp. 4610-4619.
F-star Modular Antibodies Fact Sheet, Apr. 2008, "Modular Antibody Technology" (w/ reference to Ruker WO 2006/072620 A1).
F-star Modular Antibodies Press Release, Mar. 28, 2008, "Antibody Engineering Company F-Star Buys Back Royalty Obligations. TVM Capital Joins Investor Syndicate."
Fudenberg, et al., Serologic Demonstration of Dual Specificity of Rabbit Bivalent Hybrid Antibody, The Journal of Experimental Medicine, 1964, vol. 119(1), pp. 151-166.
Ghendler et al., One of the CD3ε Subunits within a T Cell Receptor Complex Lies in Close Proximity to the Cβ FG Loop, J. Exp. Med., 1998, vol. 187, No. 9. pp. 1529-1536.
Gilliland, et al., Universal bispecific antibody for targeting tumor cells for destruction by cytotoxic T cells, Proc. Natl. Acad. Sci. USA, 1988, vol. 85, pp. 7719-7723.

(56) References Cited

OTHER PUBLICATIONS

Gunasekaran et al., Enhancing Antibody Fc Heterodimer Formation through Electrostatic Steering Effects, Journal of Biological Chemistry, vol. 285, No. 25, pp. 19637-10946, Apr. 16, 2010 & Supplementary Tables.

Haagen, et al., The Efficacy of CD3×CD19 Bispecific Monoclonal Antibody (BsAb) in a Clonogenic Assay: The Effect of Repeated Addition of BsAb, and Interleukin-2, Blood, 1995, vol. 85, No. 11, pp. 3208-3212.

Hamel, et al., The Role of the $V_L$- and $V_H$-Segments in the Preferential Reassociation of Immunoglobulin Subunits, Molecular Immunology, 1986, vol. 23, No. 5, pp. 503-510.

Hayden-Ledbetter, et al., CD20-Directed Small Modular Immunopharmaceutical, TRU-015, Depletes Normal and Malignant B Cells, Clin Cancer Res, 2009, vol. 15(8), pp. 2739-2746.

Hernandez-Caselles, et al., A study of CD33 (SIGLEC-3) antigen expression and function on activated human T and NK cells: two isoforms of CD33 are generated by alternative splicing, J. Leukoc. Biol., 2006, vol. 79, pp. 46-58.

Hexham, et al., Influence of relative binding affinity on efficacy in a panel of anti-CD3 scFv immunotoxins, Molecular Immunology, 2001, vol. 38, pp. 397-408.

Hoffmann, et al., Serial killing of tumor cells by cytotoxic T cells redirected with a CD19-/CD3-bispecific single-chain antibody construct, Int. J. Cancer, 2005, vol. 115, pp. 98-104.

Houtenbos, et al., The novel bispecific diabody αCD40/αCD28 strengthens leukaemic dendritic cell-induced T-cell reactivity, British Journal of Haematology, 2008, vol. 142, pp. 273-283.

Igawa, $V_H/V_L$ interface engineering to promote selective expression and inhibit conformational isomerization of thrombopoietin receptor agonist single-chain diabody, Protein Engineering, Design & Selection, 2010, vol. 23, No. 8, pp. 667-677.

Jäger, et al., The Trifunctional Antibody Ertumaxomab Destroys Tumor Cells That Express Low Levels of Human Epidermal Growth Factor Receptor 2, Cancer Res, 2009, vol. 69(10), pp. 4270-4276.

Jespers, et al., Crystal Structure of HEL4, a Soluble, Refoldable Human $V_H$ Single Domain with a Germ-line Scaffold, J. Mol. Biol., 2004, vol. 337, pp. 893-903.

Jimenez, et al., A recombinant, fully human, bispecific antibody neutralizes the biological activities mediated by both vascular endothelial growth factor receptors 2 and 3, Mol Cancer Ther, 2005, vol. 4(3), pp. 427-434.

Jin, et al., MetMAb, the One-Armed 5D5 Anti-c-Met Antibody, Inhibits Orthotopic Pancreatic Tumor Growth and Improves Survival, Cancer Res 2008, vol. 68, pp. 4360-4368.

Johnson, et al., Effector Cell Recruitment with Novel Fv-based Dual-affinity Re-targeting Protein Leads to Potent Tumor Cytolysis and in Vivo B-cell Depletion, J. Mol. Biol., 2010, vol. 399, pp. 436-449.

Jordan et al., Structural understanding of stabilization patterns in engineered bispecific Ig-like antibody molecules, Proteins 2009; 77:832-841, Jun. 19, 2009.

Jung, et al., Design of interchain disulfide bonds in the framework region of the Fv fragment of the monoclonal antibody B3, Proteins, 1994, vol. 19(1), pp. 35-47.

Jung, et al., Target Cell-restricted Triggering of the CD95 (APO-1/Fas) Death Receptor with Bispecific Antibody Fragments, Cancer Research, 2001, vol. 61, pp. 1846-1848.

Keyna, et al., Surrogate Light Chain-Dependent Selection of Ig Heavy Chain V Regions, J. Immunol., 1995, vol. 155, pp. 5536-5542.

Kiewe, et al., Phase I Trial of the Trifunctional Anti-HER2×Anti-CD3 Antibody Ertumaxomab in Metastatic Breast Cancer, Clin Cancer Res., 2006, vol. 12(10), pp. 3085-3091.

Kipriyanov, et al., Bispecific CD3×CD19 Diabody for T Cell-Mediated Lysis of Malignant Human B Cells, Int. J. Cancer, 1998. vol. 77, pp. 763-772.

Kipriyanov, et al., Bispecific Tandem Diabody for Tumor Therapy with Improved Antigen Binding and Pharmacokinetics, J. Mol. Biol., 1999, vol. 293, pp. 41-56.

Kipriyanov, et al., Effect of Domain Order on the Activity of Bacterially Produced Bispecific Single-chain Fv Antibodies, J. Mol. Biol., 2003, vol. 330, pp. 99-111.

Kipriyanov, et al., Two amino acid mutations in an anti-human CD3 single chain Fv antibody fragment that affect the yield on bacterial secretion but not the affinity, Protein Engineering, 1997, vol. 10, No. 4, pp. 445-453.

Klinger, et al., Immunopharmacologic response of patients with B-lineage acute lymphoblastic leukemia to continuous infusion of T cell—engaging CD19/CD3-bispecific BiTE antibody blinatumomab, Blood, 2012, vol. 119, No. 26, pp. 6226-6233.

Koristka, et al., Retargeting of Human Regulatory T Cells by Single-Chain Bispecific Antibodies, The Journal of Immunology, 2012, vol. 188, pp. 1551-1558, www.jimmunol.org/cgi/doi/10.4049/jimmunol.1101760.

Kostelny, et al., Formation of a Bispecific Antibody by the Use of Leucine Zippers, The Journal of Immunology 1992, vol. 148, pp. 1547-1553.

Krupka, et al., CD33 target validation and sustained depletion of AML blasts in long-term cultures by the bispecific T-cell-engaging antibody AMG 330, Blood, 2014, vol. 123, No. 3, pp. 356-365, Prepublished online Dec. 3, 2013; doi:10.1182/blood-2013-08-523548 & Data Supplement.

Kung, et al., Monoclonal Antibodies Defining Distinctive Human T Cell Surface Antigens, Science, 1979, vol. 206, pp. 347-349.

Laszlo et al., Cellular determinants for preclinical activity of a novel CD33/CD3 bispecific T-cell engager (BiTE) antibody, AMG 330, against human AML, blood 2014 123: 554-561, Dec. 5, 2013.

Li, et al., Construction and characterization of a humanized anti-human CD3 monoclonal antibody 12F6 with effective immunoregulation functions, Immunology, 2005, vol. 116, pp. 487-498.

Lindhofer, et al., Preferential Species-Restricted Heavy/Light Chain Pairing in Rat/Mouse Quadromas: Implications for a Single-Step Purification of Bispecific Antibodies, The Journal of Immunology, 1995, vol. 155, pp. 219-225.

Ling, et al., Interspecies Scaling of Therapeutic Monoclonal Antibodies: Initial Look, J Clin Pharmacol, 2009, vol. 49, pp. 1382-1402, doi: 10.1177/0091270009337134.

Link, et al., Production and Characterization of a Bispecific IgG Capable of Inducing T-Cell-Mediated Lysis of Malignant B Cells, Blood, 1993, vol. 81, No. 12, pp. 3343-3349.

Linke, et al., Catumaxomab, Clinical development and future directions, mAbs, 2010, vol. 2, Issue 2, pp. 129-136.

Little, et al., Letter to the Editor, "Flawed TandAb production," Molecular Immunology, 2007, vol. 44, p. 3083.

Liu et al, Asymmetrical Fc Engineering Greatly Enhances Antibody-dependent Cellular Cytotoxicity (ADCC) Effector Function and Stability of the Modified Antibodies, J. Biol. Chem. 2014, 289: 3571-3590, Dec. 5, 2013.

Liu, et al., Crystallization of a Deglycosylated T Cell Receptor (TCR) Complexed with an Anti-TCR Fab Fragment, The Journal of Biological Chemistry, 1996, vol. 271, No. 52, pp. 33639-33646.

Löffler, et al., A recombinant bispecific single-chain antibody, CD19×CD3, induces rapid, and high lymphoma-directed cytotoxicity by unstimulated T lymphocytes, Blood, 2000, vol. 95, No. 6, pp. 2098-2103.

Lu, et al., A Fully Human Recombinant IgG-like Bispecific Antibody to Both the Epidermal Growth Factor Receptor and the Insulin-like Growth Factor Receptor for Enhanced Antitumor Activity, The Journal of Biological Chemistry, 2005, vol. 280, No. 20, pp. 19665-19672.

Lu, et al., Di-diabody: a novel tetravalent bispecific antibody molecule by design, Journal of Immunological Methods, 2003, vol. 279, pp. 219-232.

Lu, et al., Fab-scFv fusion protein: an efficient approach to production of bispecific antibody fragments, Journal of Immunological Methods, 2002, vol. 267, pp. 213-226.

Lu, et al., The effect of variable domain orientation and arrangement on the antigen-binding activity of a recombinant human bispecific diabody, Biochemical and Biophysical Research Communications, 2004, vol. 318, pp. 507-513.

Lum, et al., The new face of bispecific antibodies: targeting cancer and much more, Experimental Hematology, 2006, vol. 34, pp. 1-6.

(56) References Cited

OTHER PUBLICATIONS

Lutterbuese, et al., AACR Poster, "Conversion of Cetuximab, Panitumumab, Trastuzumab and Omalizumab into T Cell-engaging BiTE Antibodies Creates Novel Drug Candidates of High Potency," 2008.
Lutterbuese, et al., T cell-engaging BiTE antibodies specific for EGFR potently eliminate KRAS- and BRAF-mutated colorectal cancer cells, PNAS Early Edition, 2010, www.pnas.org/cgi/doi/10.1073/pnas.1000976107 & Supporting Information.
Mabry, et al., A dual-targeting PDGFRβ/VEGF—A molecule assembled from stable antibody fragments demonstrates anti-angiogenic activity in vitro and in vivo, mAbs, 2010, vol. 2, Issue 1, pp. 20-34; www.landesbioscience.com/journals/mabs/article/10498 & Supplemental Information.
Mabry, et al., Engineering of stable bispecific antibodies targeting IL-17A and IL-23, Protein Engineering, Design & Selection, 2009, vol. 23, No. 3, pp. 115-127; doi:10.1093/protein/gzp073 & Supplementary Figures 1-8.
Mack, et al., A small bispecific antibody construct expressed as a functional single-chain molecule with high tumor cell cytotoxicity, Proc. Natl. Acad. Sci. USA, 1995, vol. 92, pp. 7021-7025.
Ma, et al., Expression and Characterization of a Divalent Chimeric Anti-Human CD3 Single Chain Antibody, Scand.J.Immunol, 1996, vol. 43, pp. 134-139.
MacroGenics Factsheet, Dual Affinity Re-Targeting ("DART") Platform, 2010.
Mandy, et al., Effect of Reduction of Several Disulfide Bonds on the Properties and Recombination of Univalent Fragments of Rabbit Antibody, The Journal of Biological Chemistry, 1963, vol. 238, No. 1, pp. 206-213.
Mandy, et al., Recombination of Univalent Subunits Derived from Rabbit Antibody, The Journal of Biological Chemistry, 1961, vol. 236, No. 12, pp. 3221-3226.
Martin, et al., Generation of the Germline Peripheral B Cell Repertoire: VH81X-λ B Cells are Unable to Complete All Developmental Programs, J. Immunol., 1998, vol. 160, pp. 3748-3758.
Martinez, et al., Characterization of a novel modification on IgG2 light chain: Evidence for the presence of O-linked mannosylation, J. Chromatogr. A, 2007, vol. 1156 pp. 183-187.
Marvin, Bispecific antibodies for dual-modality cancer therapy: killing two signaling cascades with one stone, Curr Opin Drug Discov Devel, 2006, vol. 9(2), pp. 184-193.
Marvin, et al., Recombinant approaches to IgG-like bispecific antibodies, Acta Pharmacologica Sinica, 2005, vol. 26 (6), pp. 649-658.
McPhee, Engineering human immunodeficiency virus 1 protease heterodimers as macromolecular inhibitors of viral maturation, Proc. Natl. Acad. Sci. USA, 1996, vol. 93, pp. 11477-11481.
Meijer, et al., Isolation of Human Antibody Repertoires with Preservation of the Natural Heavy and Light Chain Pairing, J. Mol. Biol., 2006, vol. 358, pp. 764-772.
Merchant, et al., An efficient route to human bispecific IgG, Nature Biotechnology, 1998, vol. 16, pp. 677-681.
Metz, et al., Bispecific digoxigenin-binding antibodies for targeted payload delivery, PNAS, 2011, vol. 108, No. 20, pp. 8194-8199.
Metz, et al., Bispecific antibody derivatives with restricted binding functionalities that are activated by proteolytic processing, Protein Engineering, Design & Selection, 2012, vol. 25, No. 10, pp. 571-580.
Michaelson et al., Anti-tumor activity of stability-engineered IgG-like bispecific antibodies targeting TRAIL-R2 and LTbetaR, [mAbs 1:2, 128-141; Mar./Apr. 2009]; Mar. 11, 2009.
Miller et al., Stability engineering of scFvs for the development of bispecific and multivalent antibodies, PEDS, 2010, vol. 23, No. 7, pp. 549-557 & Supplementary Information.
Mimoto, et al., Novel asymmetrically engineered antibody Fc variant with superior FcγR binding affinity and specificity compared with afucosylated Fc variant, mAbs, 2013, vol. 5, Issue 2, pp. 229-236.
Mølhøj, et al., CD19-/CD3-bispecific antibody of the BiTE class is far superior to tandem diabody with respect to redirected tumor cell lysis, Molecular Immunology 2007, vol. 44, pp. 1935-1943.
Moore, et al., Application of dual affinity retargeting molecules to achieve optimal redirected T-cell killing of B-cell lymphoma, Blood, 2011, vol. 117, No. 17, pp. 4542-4551.
Moretti et al., BEAT® the bispecific challenge: a novel and efficient platform for the expression of bispecific IgGs. BMC Proceedings 2013 7(Suppl 6):O9.
Morrison, et al., News and Views: Two heads are better than one, Nature Biotechnology, 2007, vol. 25, No. 11, pp. 1233-1234.
Muda, et al., Therapeutic assessment of SEED: a new engineered antibody platform designed to generate mono and bispecific antibodies, Protein Engineering, Design & Selection, 2011, vol. 24, No. 5, pp. 447-454.
Nagorsen, et al., Blinatumomab: A historical perspective, Pharmacology & Therapeutics, 2012, vol. 136, pp. 334-342, http://dx.doi.org/10.1016/j.pharmthera.2012.07.013.
Nelson, et al., Point of View: Antibody fragments—Hope and hype, mAbs, 2010, vol. 2, Issue 1, pp. 77-83.
Nielsen, et al., Human T cells resistant to complement lysis by bivalent antibody can be efficiently lysed by dimers of monovalent antibody, Blood, 2002, vol. 100, No. 12, pp. 4067-4073.
Nisonoff, et al., Letters to the Editors: Recombination of a Mixture of Univalent Antibody Fragments of Different Specificity, Arch. Biochem. Biophys., 1961, pp. 460-462.
Nisonoff, et al., Quantitative Estimation of the Hybridization of Rabbit Antibodies, Nature, 1962, vol. 194, No. 4826, pp. 355-359.
North, et al., A New Clustering of Antibody CDR Loop Conformations, J. Mol. Biol., 2011, vol. 406, pp. 228-256, doi:10.1016/j.jmb.2010.10.030.
Olafsen, et al., Covalent disulfide-linked anti-CEA diabody allows site-specific conjugation and radiolabeling for tumor targeting applications, Protein Engineering, Design & Selection, 2004, vol. 17, No. 1, pp. 21-27.
Panke, et al., Quantification of cell surface proteins with bispecific antibodies, Protein Engineering, Design & Selection, 2013, vol. 26, No. 10, pp. 645-654.
Pessano, et al., The T3/T cell receptor complex: antigenic distinction between the two 20-kd T3 (T3-δ and T3-ε) subunits, The EMBO Journal, 1985, vol. 4, No. 2, pp. 337-344.
Pichler et al., Differences of T-Cell Activation by the Anti-CD3 Antibodies Leu4 and BMA030, Mar. 30, 1987.
Potapov et al., Protein—Protein Recognition: Juxtaposition of Domain and Interface Cores in Immunoglobulins and Other Sandwich-like Proteins, J. Mol. Biol., 2004, vol. 342, pp. 665-679.
Rattel, et al., AACR Poster, "Validation of Cynomolgus Monkeys as Relevant Species for Safety Assessment of a Novel Human BiTE Antibody Platform for Cancer Therapy," 2010.
Reiter et al., Disulfide stabilization of antibody Fv: computer predictions and experimental evaluation, Protein Eng., 1995, vol. 8(12), pp. 1323-1331.
Reiter et al., Engineering interchain disulfide bonds into conserved framework regions of Fv fragments: improved biochemical characteristics of recombinant immunotoxins containing disulfide-stabilized Fv, Protein Eng., 1994, vol. 7(5), pp. 697-704.
Repp, et al., Combined Fc-protein- and Fc-glyco-engineering of scFv-Fc fusion proteins synergistically enhances CD16a binding but does not further enhance NK-cell mediated ADCC, Journal of Immunological Methods, 2011, vol. 373, Issues 1-2, pp. 67-78.
Ridgway, et al., 'Knobs-into-holes' engineering of antibody CH3 domains for heavy chain heterodimerization, Protein Engineering, 1996, vol. 9, No. 7, pp. 617-621.
Riethmüller, Symmetry breaking: bispecific antibodies, the beginnings, and 50 years on, Cancer Immunity, 2012, vol. 12, p. 12, pp. 1-7.
Roosnek, et al., Triggering T Cells by Otherwise Inert Hybrid Anti-CD3/Antitumor Antibodies Requires Encounter with the Specific Target Cell, J. Exp. Med., 1989, vol. 170, pp. 297-302.
Rose, et al., Mutation of Y407 in the CH3 domain dramatically alters glycosylation and structure of human IgG, mAbs, 2013, vol. 5, Issue 2, pp. 219-228.

(56) References Cited

OTHER PUBLICATIONS

Rose, et al., Quantitative Analysis of the Interaction Strength and Dynamics of Human IgG4 Half Molecules by Native Mass Spectrometry, Structure, 2011, vol. 19, pp. 1274-1282.
Rossi, et al., A new class of bispecific antibodies to redirect T cells for cancer immunotherapy, mAbs 2014, vol. 6, Issue 2, pp, 381-391.
Roux, et al., Structural analysis of the nurse shark (new) antigen receptor (NAR): Molecular convergence of NAR and unusual mammalian immunoglobulins, Proc. Natl. Acad. Sci. USA, 1998, vol. 95, pp. 11804-11809.
Rudnick, et al., Affinity and Avidity in Antibody-Based Tumor Targeting, Cancer Biotherapy and Radiopharmaceuticals, 2009, vol. 24, No. 2, pp. 155-161, doi: 10.1089/cbr.2009.0627.
Röthlisberger, et al., Domain Interactions in the Fab Fragment: A Comparative Evaluation of the Single-chain Fv and Fab Format Engineered with Variable Domains of Different Stability, J. Mol. Biol., 2005, vol. 347, pp. 773-789.
Salmeron et al., A conformational epitope expressed upon association of CD3-epsilon with either CD3-delta or CD3-gamma is the main target for recognition by anti-CD3 monoclonal antibodies, Nov. 1, 1991.
Sancho et al., CD3—Surface Expression is Required for CD4-p56ick-mediated Up-regulation of T Cell Antigen Receptor-CD3 Signaling in T Cells, Apr. 16, 1992.
Schaefer, et al., A Two-in-One Antibody against HER3 and EGFR Has Superior Inhibitory Activity Compared with Monospecific Antibodies, Cancer Cell, 2011, vol. 20, pp. 472-486 & Supplemental Information, pp. 1-21.
Schlapschy, et al., Functional humanization of an anti-CD16 Fab fragment: obstacles of switching from murine λ to human λ or κ light chains, Protein Engineering, Design & Selection, 2009, vol. 22, No. 3, pp. 175-188, doi:10.1093/protein/gzn066.
Schlereth, et al., Eradication of Tumors from a Human Colon Cancer Cell Line and from Ovarian Cancer Metastases in Immunodeficient Mice by a Single-Chain Ep-CAM-/CD3-Bispecific Antibody Construct, Cancer Res 2005, vol. 65(7), pp. 2882-2889.
Schlereth, et al., T-cell activation and B-cell depletion in chimpanzees treated with a bispecific anti-CD19/anti-CD3 single-chain antibody construct, Cancer Immunol Immunother, 2006, vol. 55, pp. 503-514, doi:10.1007/s00262-005-0001-1.
Schoonjans, et al., Fab Chains as an Efficient Heterodimerization Scaffold for the Production of Recombinant Bispecific and Trispecific Antibody Derivatives, The Journal of Immunology, 2000, vol. 165, pp. 7050-7057.
Shalaby, et al., Development of Humanized Bispecific Antibodies Reactive with Cytotoxic Lymphocytes and Tumor Cells Overexpressing the HER2 Protooncogene, J.Exp.Med., 1992, vol. 175, pp. 217-225.
Shan, et al., Characterization of scFv-Ig Constructs Generated from the Anti-CD20 mAb 1F5 Using Linker Peptides of Varying Lengths, J Immunol, 1999, vol. 162, pp. 6589-6595.
Shearman, et al., Construction, Expression and Characterization of Humanized Antibodies Directed Against the Human α/β T Cell Receptor, The Journal of Immunology, 1991, vol. 147, No. 12, pp. 4366-4373.
Shen, et al., Single Variable Domain-IgG Fusion: A Novel Recombinant Approach to Fc Domain-Containing Bispecific Antibodies, The Journal of Biological Chemistry, 2006, vol. 281, No. 16, pp. 10706-10714.
Shen, et al., Catumaxomab, a rat/murine hybrid trifunctional bispecific monoclonal antibody for the treatment of cancer, Curr Opin Mol Ther, 2008, vol. 10(3), pp. 273-284.
Spiess, et al., Bispecific antibodies with natural architecture produced by co-culture of bacteria expressing two distinct half-antibodies, Nature Biotechnology, 2013, doi:10.1038/nbt.2621 & Supplemental Information.
Stamova, Unexpected recombinations in single chain bispecific anti-CD3-anti-CD33 antibodies can be avoided by a novel linker module, Oct. 29, 2011.

Stanfield, et al., Maturation of Shark Single-domain (IgNAR) Antibodies: Evidence for Induced-fit Binding, J. Mol. Biol., 2007, vol. 367, pp. 358-372.
Strop, P. et al., Generating Bispecific Human IgG1 and IgG2 Antibodies from Any Antibody Pair, J. Mol. Biol., 2012, doi:10.1016/j.jmb.2012.04.020.
Tan, Philip, Presentation at PepTalk, Jan. 25, 2013, "Bi-specific ADAPTIR Molecule Targeting CD86 and Delivering Monomeric IL10 to Inhibit Antigen Presenting Cells".
Tarcsa et al, Chapter 10 Dual-Variable Domain Immunoglobulin (DVD-Ig™) Technology: A Versatile, Novel Format for the Next Generation of Dual-Targeting Biologics, Bispecific Antibodies 2011, pp. 171-185, 2011.
Teachey, et al., Cytokine release syndrome after blinatumomab treatment related to abnormal macrophage activation and ameliorated with cytokine-directed therapy, Blood, 2013, vol. 121, No. 26, pp. 5154-5157.
Thompson, et al., Improved binding of a bivalent single-chain immunotoxin results in increased efficacy for in vivo T-cell depletion, Protein Engineering, 2001, vol. 14, No. 12, pp. 1035-1041.
Thompson, et al., An Anti-CD3 Single-chain Immunotoxin with a Truncated Diphtheria Toxin Avoids Inhibition by Pre-existing Antibodies in Human Blood, J.Biol.Chem., 1995, vol. 270, No. 47, pp. 28037-28041.
Traunecker, et al., Bispecific single chain molecules (Janusins) target cytotoxic lymphocytes on HIV infected cells, The EMBO Journal, 1991, vol. 1, No. 12, pp. 3655-3659.
Valliere-Douglass, et al., O-Fucosylation of an antibody light chain: Characterization of a modification occurring on an IgG1 molecule, Glycobiology, 2009, vol. 19, No. 2, pp. 144-152, doi:10.1093/glycob/cwn116.
van Boxel, et al., Some lessons from the systematic production and structural analysis of soluble αβ T-cell receptors, Journal of Immunological Methods, 2009, vol. 350, pp. 14-21.
van Wauwe, et al., OKT3: A Monoclonal Anti-Human T Lymphoctye Antibody with Potent Mitogenic Properties, The Journal of Immunology, 1980, vol. 124, No. 6, pp. 2708-2713.
Verdier, et al., Determination of lymphocyte subsets and cytokine levels in Cynomolgus monkeys, Toxicology, 1995, vol. 105, pp. 81-90.
Veri, et al., Therapeutic Control of B Cell Activation via Recruitment of Fcγ Receptor IIb (CD32B) Inhibitory Function With a Novel Bispecific Antibody Scaffold, Arthritis & Rheumatism, 2010, vol. 62, No. 7, pp. 1933-1943.
Vettermann, et al., Powered by pairing: The surrogate light chain amplifies immunoglobulin heavy chain signaling and pre-selects the antibody repertoire, Seminars in Immunology 18, 2006, pp. 44-55.
Von Kreudenstein, et al., Improving biophysical properties of a bispecific antibody scaffold to aid developability: Quality by molecular design, mAbs, 2013, vol. 5, Issue 5, pp. 1-9, http://dx.doi.org/10.4161/mabs.25632 & Supplemental Material.
Wang et al., Conserved amino acid networks involved in antibody variable domain interactions, Nov. 11, 2008.
Wang et al., Expression and characterization of recombinant soluble monkey CD3 molecules: mapping the FN18 polymorphic epitope, Nov. 7, 2003.
Wang, et al., A block in both early T lymphocyte and natural killer cell development in transgenic mice with high-copy numbers of the human CD3E gene, Proc. Natl. Acad. Sci. USA, 1994, vol. 91, pp. 9402-9406.
Ward, et al., Protein Engineering of Homodimeric Tyrosyl-tRNA Synthetase to Produce Active Heterodimers, The Journal of Biological Chemistry, 1986, vol. 261, No. 21, pp. 9576-9578.
Weatherill, et al., Towards a universal disulphide stabilised single chain Fv format: importance of interchain disulphide bond location and vL-vH orientation, Protein Engineering, Design & Selection, 2012, vol. 25, No. 7, pp. 321-329.
Weiner, et al., The Role of T Cell Activation Bispecific Antibody Therapy in Anti-CD3×Antitumor, Journal of Immunology, 1994, vol. 152, pp. 2385-2392.
Wesolowski, et al., Single domain antibodies: promising experimental and therapeutic tools in infection and immunity, Med Microbiol Immunol, 2009, vol. 198, pp. 157-174.

(56) References Cited

OTHER PUBLICATIONS

Whitlow, et al., An improved linker for single-chain Fv with reduced aggregation and enhanced proteolytic stability, Protein Engineering, 1993, vol. 6, No. 8, pp. 989-995.

Wong, et al., The Mechanism of Anti-CD3 Monoclonal Antibodies, Transplantation, 1990, vol. 50, No. 4, pp. 683-689.

Woods, et al., LC-MS characterization and purity assessment of a prototype bispecific antibody, mAbs, 2013, vol. 5, Issue 5, pp. 711-722, http://dx.doi.org/10.4161/mabs.25488.

Wu et al, Molectular construction and optimization of anti-human IL-11α/β dual variable domain immunoglobulin (DVD-Ig™) molecules, [mAbs 1:4, 339-347; Jul./Aug. 2009]; Landes Bioscience, Apr. 10, 2009.

Wu et al, Simultaneous targeting of multiple disease mediators by a dual-variable-domain immunoglobulin, (DVD-Ig™) molecules, Jul.-Aug. 2009; 339-347, Oct. 14, 2007.

Wu, et al., Multimerization of a chimeric anti-CD20 single-chain Fv-Fc fusion protein is mediated through variable domain exchange, Protein Engineering, 2001, vol. 14, No. 12, pp. 1025-1033.

Wucherpfennig, et al., Structural Biology of the T-cell Receptor: Insights into Receptor Assembly, Ligand Recognition, and Initiation of Signaling, Cold Spring Harb Perspect Biol 2010;2:a005140.

Xie, et al., A new format of bispecific antibody: highly efficient heterodimerization, expression and tumor cell lysis, Journal of Immunological Methods, 2005, vol. 296, pp. 95-101, doi:10.1016/j.jim.2004.11.005.

Xu, et al., Combinatorial surrobody libraries, PNAS, 2008, vol. 105, No. 31, pp. 10756-10761.

Xu, et al., Rapid optimization and prototyping for therapeutic antibody-like molecules, mAbs, 2013, vol. 5, Issue 2, pp. 237-254.

Xu, et al., Surrobodies with Functional Tails, J. Mol. Biol., 2010, vol. 397, pp. 352-360.

Yang et al., Differential in vitro activation of CD8-CD4+ and CD4-CD8+ T lymphocytes by combinations of anti-CD2 and anti-CD3 antibodies, Apr. 1, 1988.

Yoshino et al., Upgrading of flow cytometric analysis for absolute counts, cytokines and other antigenic molecules of cynomolgus monkeys (*Macaca fascicularis*) by using anti-human cross-reactive antibodies, Exp. Anim., 2000, vol. 49(2), pp. 97-100.

Zeidler, et al., The Fc-region of a new class of intact bispecific antibody mediates activation of accessory cells and NK cells and induces direct phagocytosis of tumour cells, Br J Cancer, 2000, vol. 83(2), pp. 261-266.

Zhu, et al., Identification of Heavy Chain Residues in a Humanized Anti-CD3 Anti-body Important for Efficient Antigen Binding and T Cell Activation, The Journal of Immunology, 1995, vol. 155, pp. 1903-1910.

Zhu, et al., Remodeling domain interfaces to enhance heterodimer formation, Protein Science, 1997, vol. 6, pp. 781-788.

Zuo, et al., An efficient route to the production of an IgG-like bispecific antibody, Protein Engineering, 2000, vol. 13, No. 5, pp. 361-367.

Chu et al., Immunotherapy with Long-Lived Anti-CD123×Anti-CD3 Bispecific Antibodies Stimulates Potent T Cell-Mediated Killing of Human B Cell Lines and of Circulating and Lymphoid B Cells in Monkeys: A Potential Therapy for B Cell Lymphomas and Leukemias, Blood 2014, 124:3111.

Sun et al., Anti-CD20/CD3 T cell-dependent bispecific antibody for the treatment of B cell malignancies., Science Translational Medicine May 13, 2015: vol. 7, Issue 287, pp. 287ra70 DOI: 10.1126/scitranslmed.aaa480.

Capizzi et al., Curative chemotherapy for acute myeloid leukemia: the development of high-dose ara-C from the laboratory to bedside., Invest New Drugs. 1996;14(3):249-56.

Giles et al., Intravenous corticosteroids to reduce gemtuzumab ozogamicin infusion reactions. Ann Pharmacother. Sep. 2003;37(9):1182-5.

Duong et al., Targeted treatment of acute myeloid leukemia in older adults: role of gemtuzumab ozogamicin., Clin Intery Aging. 2009;4:197-205. Epub May 14, 2009.

Muramatsu et al., Production and characterization of an active single-chain variable fragment antibody recognizing CD25., Cancer Lett. Jul. 28, 2005;225(2):225-36. Epub Jan. 23, 2005.

Sforzini et al., Targeting of saporin to Hodgkin's lymphoma cells by anti-CD30 and anti-CD25 bispecific antibodies., Br J Haematol. Sep. 1998;102(4):1061-8.

Smith et al., Mouse model recapitulating human Fcγ receptor structural and functional diversity., Proc Natl Acad Sci U S A. Apr. 17, 2012;109(16):6181-6. doi: 10.1073/pnas.1203954109. Epub Apr. 2, 2012.

Tabrizi et al., Biodistribution mechanisms of therapeutic monoclonal antibodies in health and disease., AAPS J. Mar. 2010;12(1):33-43. doi: 10.1208/s12248-009-9157-5. Epub Nov. 19, 2009.

DiGiandomenico et al., A multifunctional bispecific antibody protects against Pseudomonas aeruginosa., *Sci Transl Med.* Nov. 12, 2014;6(262):262ra155. doi: 10.1126/scitranslmed.3009655.

Sun et al., Preclinical Characterization of Combinability and Potential Synergy of Anti-CD20/CD3 T-Cell Dependent Bispecific Antibody with Chemotherapy and PD-1/PD-L1 Blockade., Blood 2016 128:4168.

Chichili et al., Co-targeting of PD-1 and CTLA-4 Inhibitory Pathways with Bispecific DART® and TRIDENT™ Molecules., Apr. 4, 2017, retrieved from the internet: http://files.shareholder.com/downloads/AMDA-278VRP/0x0x935572/8CC86417-40BA-41C0-935D-EF1B7DB0B5BB/AACR_2017_-_Co-targeting_PD-1_and_CTLA-4_Inhibitory_Pathways_with_DART_and_TRIDENT_Molecules.pdf.

Kharmate et al., Inhibition of tumor promoting signals by activation of SSTR2 and opioid receptors in human breast cancer cells., Cancer Cell Int. Sep. 23, 2013;13(1):93. doi: 10.1186/1475-2867-13-93.

Ott et al., CTLA-4 and PD-1/PD-L1 blockade: new immunotherapeutic modalities with durable clinical benefit in melanoma patients., Clin Cancer Res. Oct. 1, 2013;19(19):5300-9. doi: 10.1158/1078-0432.CCR-13-0143.

Spranger et al., Mechanism of tumor rejection with doublets of CTLA-4, PD-1/PD-L1, or IDO blockade involves restored IL-2 production and proliferation of CD8(+) T cells directly within the tumor microenvironment., J Immunother Cancer. Feb. 18, 2014;2:3. doi: 10.1186/2051-1426-2-3. eCollection 2014.

Bernett et al., Multiple Bispecific Checkpoint Combinations Promote T cell activation., Nov. 11, 2016, retrieved from the internet: http://files.shareholder.com/downloads/AMDA-2B2V8N/0x0x916283/67AE1A8B-40E8-4316-9F79-384D06B2C395/XNCR_SITC_2016_PD1xCTLA4_Poster126_12Nov2016.pdf.

Hedvat et al., Dual Blockade of PD-1 and CTLA-4 with Bispecific Antibodies Promotes Human T cell Activation and Proliferation., Nov. 11, 2016, retrieved from the internet: http://files.shareholder.com/downloads/AMDA-2B2V8N/0x0x916284/D8084990-61EC-4DFE-81376-60CF58B8C06F/CPI_bispecifics.pdf.

Zamyatnin AA., Amino Acid, Peptide, and Protein Volume in Solution., Annu Rev Biophys Bioeng. 1984;13:145-65.

Zalevsky et al. "Enhanced antibody half-life improves in vivo activity." Nature Biotechnology, vol. 28, No. 2, Feb. 1, 2010, pp. 157-159.

Ziebig et al., Effect of the oxLDL Binding Protein Fc-CD68 on Plaque Extension and Vulnerability in Atherosclerosis., Circulation Research 108: 695-703, 2011.

Ishigaki et al., Impact of Plasma Oxidized Low-Density Lipoprotein Removal on Atherosclerosis., Circulation 118: 75-83, 2008.

Chu et al., Inhibition of B cell receptor-mediated activation of primary human B cells by coengagement of CD19 and FcgammaRIIb with Fc-engineered antibodies., Mol Immunol. Sep. 2008;45(15):3926-33. doi: 10.1016/j.molimm.2008.06.027. Epub Aug. 8, 2008.

\* cited by examiner

Figure 1

Kappa constant light chain (CK) (SEQ ID NO: 1)

RTVAAPSVFIFPPSDEQLKSGTASVVCLLNNFYPREAKVQWKVDNALQSGNSQESVTEQ
DSKDSTYSLSSTLTLSKADYEKHKVYACEVTHQGLSSPVTKSFNRGEC

IgG1 constant heavy chain (CH1-hinge-CH2-CH3) (SEQ ID NO: 2)

ASTKGPSVFPLAPSSKSTSGGTAALGCLVKDYFPEPVTVSWNSGALTSGVHTFPAVLQS
SGLYSLSSVVTVPSSSLGTQTYICNVNHKPSNTKVDKKVEPKSCDKTHTCPPCPAPELLG
GPSVFLFPPKPKDTLMISRTPEVTCVVVDVSHEDPEVKFNWYVDGVEVHNAKTKPREEQ
YNSTYRVVSVLTVLHQDWLNGKEYKCKVSNKALPAPIEKTISKAKGQPREPQVYTLPPSR
EEMTKNQVSLTCLVKGFYPSDIAVEWESNGQPENNYKTTPPVLDSDGSFFLYSKLTVDK
SRWQQGNVFSCSVMHEALHNHYTQKSLSLSPGK

IgG2 constant heavy chain (CH1-hinge-CH2-CH3) (SEQ ID NO: 3)

ASTKGPSVFPLAPCSRSTSESTAALGCLVKDYFPEPVTVSWNSGALTSGVHTFPAVLQS
SGLYSLSSVVTVPSSNFGTQTYTCNVDHKPSNTKVDKTVERKCCVECPPCPAPPVAGPS
VFLFPPKPKDTLMISRTPEVTCVVVDVSHEDPEVQFNWYVDGVEVHNAKTKPREEQFNS
TFRVVSVLTVVHQDWLNGKEYKCKVSNKGLPAPIEKTISKTKGQPREPQVYTLPPSREE
MTKNQVSLTCLVKGFYPSDIAVEWESNGQPENNYKTTPPMLDSDGSFFLYSKLTVDKSR
WQQGNVFSCSVMHEALHNHYTQKSLSLSPGK

IgG3 constant heavy chain (CH1-hinge-CH2-CH3) (SEQ ID NO: 4)

ASTKGPSVFPLAPCSRSTSGGTAALGCLVKDYFPEPVTVSWNSGALTSGVHTFPAVLQS
SGLYSLSSVVTVPSSSLGTQTYTCNVNHKPSNTKVDKRVELKTPLGDTTHTCPRCPEPK
SCDTPPPCPRCPEPKSCDTPPPCPRCPEPKSCDTPPPCPRCPAPELLGGPSVFLFPPKP
KDTLMISRTPEVTCVVVDVSHEDPEVQFKWYVDGVEVHNAKTKPREEQYNSTFRVVSVL
TVLHQDWLNGKEYKCKVSNKALPAPIEKTISKTKGQPREPQVYTLPPSREEMTKNQVSL
TCLVKGFYPSDIAVEWESSGQPENNYNTTPPMLDSDGSFFLYSKLTVDKSRWQQGNIFS
CSVMHEALHNRFTQKSLSLSPGK

IgG4 constant heavy chain (CH1-hinge-CH2-CH3) (SEQ ID NO: 5)

ASTKGPSVFPLAPCSRSTSESTAALGCLVKDYFPEPVTVSWNSGALTSGVHTFPAVLQS
SGLYSLSSVVTVPSSSLGTKTYTCNVDHKPSNTKVDKRVESKYGPPCPSCPAPEFLGGP
SVFLFPPKPKDTLMISRTPEVTCVVVDVSQEDPEVQFNWYVDGVEVHNAKTKPREEQFN
STYRVVSVLTVLHQDWLNGKEYKCKVSNKGLPSSIEKTISKAKGQPREPQVYTLPPSQE
EMTKNQVSLTCLVKGFYPSDIAVEWESNGQPENNYKTTPPVLDSDGSFFLYSRLTVDKS
RWQEGNVFSCSVMHEALHNHYTQKSLSLSLGK

IgG1/2 constant heavy chain (CH1-hinge-CH2-CH3) (SEQ ID NO: 6)

ASTKGPSVFPLAPSSKSTSGGTAALGCLVKDYFPEPVTVSWNSGALTSGVHTFPAVLQS
SGLYSLSSVVTVPSSSLGTQTYICNVNHKPSNTKVDKKVEPKSCDKTHTCPPCPAPPVA
GPSVFLFPPKPKDTLMISRTPEVTCVVVDVSHEDPEVQFNWYVDGVEVHNAKTKPREEQ
FNSTFRVVSVLTVVHQDWLNGKEYKCKVSNKGLPAPIEKTISKTKGQPREPQVYTLPPSR
EEMTKNQVSLTCLVKGFYPSDIAVEWESNGQPENNYKTTPPMLDSDGSFFLYSKLTVDK
SRWQQGNVFSCSVMHEALHNHYTQKSLSLSPGK

Figure 2

SEQ ID NOS. 411-414

| EU | Domain | 411 IgG1 | 412 IgG2 | 413 IgG3 | 414 IgG4 | Fraction Exposed | Notes | Subs |
|---|---|---|---|---|---|---|---|---|
| 118 | CH1 | A | A | A | A | 0.44 | | |
| 119 | CH1 | S | S | S | S | 0.69 | | DE |
| 120 | CH1 | T | T | T | T | 0.40 | | |
| 121 | CH1 | K | K | K | K | 0.37 | | DE |
| 122 | CH1 | G | G | G | G | 0.27 | | |
| 123 | CH1 | P | P | P | P | 0.10 | | |
| 124 | CH1 | S | S | S | S | 0.38 | | DE |
| 125 | CH1 | V | V | V | V | 0.05 | | |
| 126 | CH1 | F | F | F | F | 0.07 | | |
| 127 | CH1 | P | P | P | P | 0.21 | | |
| 128 | CH1 | L | L | L | L | 0.02 | | |
| 129 | CH1 | A | A | A | A | 0.22 | | DE |
| 130 | CH1 | P | P | P | P | 0.05 | | |
| 131 | CH1 | S | C | C | C | 1.00 | | DE |
| 132 | CH1 | S | S | S | S | 1.00 | | DE |
| 133 | CH1 | K | R | R | R | 1.00 | Isotypic | DE |
| 134 | CH1 | S | S | S | S | 1.00 | | DE |
| 135 | CH1 | T | T | T | T | 1.00 | | DE |
| 136 | CH1 | S | S | S | S | 1.00 | | DE |
| 137 | CH1 | G | E | G | E | 1.00 | Isotypic | DE |
| 138 | CH1 | G | S | G | S | 1.00 | | DE |
| 139 | CH1 | T | T | T | T | 0.55 | | |
| 140 | CH1 | A | A | A | A | 0.08 | | |
| 141 | CH1 | A | A | A | A | 0.02 | | |
| 142 | CH1 | L | L | L | L | 0.00 | | |
| 143 | CH1 | G | G | G | G | 0.00 | | |
| 144 | CH1 | C | C | C | C | 0.00 | | |
| 145 | CH1 | L | L | L | L | 0.02 | | |
| 146 | CH1 | V | V | V | V | 0.00 | | |
| 147 | CH1 | K | K | K | K | 0.06 | Interface w/ CL | |
| 148 | CH1 | D | D | D | D | 0.26 | | |
| 149 | CH1 | Y | Y | Y | Y | 0.00 | | |
| 150 | CH1 | F | F | F | F | 0.10 | | |
| 151 | CH1 | P | P | P | P | 0.01 | | |
| 152 | CH1 | E | E | E | E | 0.27 | | DE |
| 153 | CH1 | P | P | P | P | 0.47 | | |
| 154 | CH1 | V | V | V | V | 0.12 | | |
| 155 | CH1 | T | T | T | T | 0.44 | | DE |
| 156 | CH1 | V | V | V | V | 0.14 | | |
| 157 | CH1 | S | S | S | S | 0.32 | | DE |
| 158 | CH1 | W | W | W | W | 0.01 | | |
| 159 | CH1 | N | N | N | N | 0.20 | | DE |
| 160 | CH1 | S | S | S | S | 0.82 | | DE |
| 161 | CH1 | G | G | G | G | 0.47 | | DE |
| 162 | CH1 | A | A | A | A | 0.79 | | DE |
| 163 | CH1 | L | L | L | L | 0.18 | | |
| 164 | CH1 | T | T | T | T | 0.71 | | DE |
| 165 | CH1 | S | S | S | S | 0.66 | | DE |
| 166 | CH1 | G | G | G | G | 0.38 | | |
| 167 | CH1 | V | V | V | V | 0.24 | | |
| 168 | CH1 | H | H | H | H | 0.12 | | |

Figure 2 (cont.)

| EU | Domain | 411 IgG1 | 412 IgG2 | 413 IgG3 | 414 IgG4 | Fraction Exposed | Notes | Subs |
|---|---|---|---|---|---|---|---|---|
| 169 | CH1 | T | T | T | T | 0.37 | | |
| 170 | CH1 | F | F | F | F | 0.02 | | |
| 171 | CH1 | P | P | P | P | 0.42 | | |
| 172 | CH1 | A | A | A | A | 0.24 | | |
| 173 | CH1 | V | V | V | V | 0.23 | | |
| 174 | CH1 | L | L | L | L | 0.47 | | |
| 175 | CH1 | Q | Q | Q | Q | 0.13 | | |
| 176 | CH1 | S | S | S | S | 1.00 | | DE |
| 177 | CH1 | S | S | S | S | 0.61 | | DE |
| 178 | CH1 | G | G | G | G | 0.35 | | DE |
| 179 | CH1 | L | L | L | L | 0.19 | | |
| 180 | CH1 | Y | Y | Y | Y | 0.19 | | |
| 181 | CH1 | S | S | S | S | 0.06 | | |
| 182 | CH1 | L | L | L | L | 0.08 | | |
| 183 | CH1 | S | S | S | S | 0.02 | | |
| 184 | CH1 | S | S | S | S | 0.00 | | |
| 185 | CH1 | V | V | V | V | 0.01 | | |
| 186 | CH1 | V | V | V | V | 0.00 | | |
| 187 | CH1 | T | T | T | T | 0.21 | | |
| 188 | CH1 | V | V | V | V | 0.04 | | |
| 189 | CH1 | P | P | P | P | 0.54 | | |
| 190 | CH1 | S | S | S | S | 0.42 | | DE |
| 191 | CH1 | S | S | S | S | 0.81 | | DE |
| 192 | CH1 | S | N | S | S | 0.16 | | |
| 193 | CH1 | L | F | L | L | 0.16 | | |
| 194 | CH1 | G | G | G | G | 0.91 | | DE |
| 195 | CH1 | T | T | T | T | 0.82 | | DE |
| 196 | CH1 | Q | Q | Q | K | 0.44 | | DE |
| 197 | CH1 | T | T | T | T | 0.39 | | DE |
| 198 | CH1 | Y | Y | Y | Y | 0.04 | | |
| 199 | CH1 | I | T | T | T | 0.26 | | DE |
| 200 | CH1 | C | C | C | C | 0.00 | | |
| 201 | CH1 | N | N | N | N | 0.15 | | |
| 202 | CH1 | V | V | V | V | 0.02 | | |
| 203 | CH1 | N | D | N | D | 0.18 | Isotypic | DE |
| 204 | CH1 | H | H | H | H | 0.00 | | |
| 205 | CH1 | K | K | K | K | 0.62 | | DE |
| 206 | CH1 | P | P | P | P | 0.30 | | |
| 207 | CH1 | S | S | S | S | 0.26 | | |
| 208 | CH1 | N | N | N | N | 0.80 | | DE |
| 209 | CH1 | T | T | T | T | 0.21 | | |
| 210 | CH1 | K | K | K | K | 0.73 | | DE |
| 211 | CH1 | V | V | V | V | 0.28 | | |
| 212 | CH1 | D | D | D | D | 0.66 | | DE |
| 213 | CH1 | K | K | K | K | 0.20 | Interface w/ CL | |
| 214 | CH1 | K/R | T | R | R | 0.43 | Isotypic | DE |
| 215 | CH1 | V | V | V | V | 0.03 | | |
| 216 | CH1 | E | E | E | E | 0.50 | | DE |
| 217 | CH1 | P | R | L | S | 0.41 | | |
| 218 | CH1 | K | K | K | K | 0.86 | | DE |
| 219 | CH1 | S | C | T | Y | | | DE |
| 220 | CH1 | C | C | P | G | | | |

Figure 3

SEQ ID NO: 415

| EU | Ckappa | Fraction Exposed | Notes | Subs |
|---|---|---|---|---|
| 108 | R | 0.33 | | DE |
| 109 | T | 0.68 | | DE |
| 110 | V | 0.42 | | DE |
| 111 | A | 0.20 | | |
| 112 | A | 0.38 | | DE |
| 113 | P | 0.09 | | |
| 114 | S | 0.46 | | DE |
| 115 | V | 0.08 | | |
| 116 | F | 0.20 | | |
| 117 | I | 0.11 | | |
| 118 | F | 0.02 | | |
| 119 | P | 0.40 | | |
| 120 | P | 0.08 | | |
| 121 | S | 0.11 | | |
| 122 | D | 0.54 | | DE |
| 123 | E | 0.46 | | DE |
| 124 | Q | 0.01 | | |
| 125 | L | 0.07 | | |
| 126 | K | 0.76 | | DE |
| 127 | S | 0.65 | | DE |
| 128 | G | 0.37 | | DE |
| 129 | T | 0.34 | | DE |
| 130 | A | 0.00 | | |
| 131 | S | 0.02 | | |
| 132 | V | 0.00 | | |
| 133 | V | 0.00 | | |
| 134 | C | 0.00 | | |
| 135 | L | 0.00 | | |
| 136 | L | 0.00 | | |
| 137 | N | 0.04 | | |
| 138 | N | 0.31 | | |
| 139 | F | 0.00 | | |
| 140 | Y | 0.12 | | |
| 141 | P | 0.16 | | |
| 142 | R | 0.37 | Interface w/ VL | |
| 143 | E | 0.67 | | DE |
| 144 | A | 0.25 | | |
| 145 | K | 0.48 | | DE |
| 146 | V | 0.15 | | |
| 147 | Q | 0.17 | | DE |
| 148 | W | 0.01 | | |
| 149 | K | 0.27 | | DE |
| 150 | V | 0.04 | | |
| 151 | D | 0.43 | | DE |
| 152 | N | 0.72 | | DE |
| 153 | A | 0.47 | | DE |
| 154 | L | 0.56 | exposed hydrophobic | DE |
| 155 | Q | 0.22 | | |
| 156 | S | 0.80 | | DE |
| 157 | G | 0.97 | | DE |
| 158 | N | 0.35 | | |

Figure 3 (cont.)

| EU | Ckappa | Fraction Exposed | Notes | Subs |
|---|---|---|---|---|
| 159 | S | 0.36 | | |
| 160 | Q | 0.34 | | |
| 161 | E | 0.46 | | |
| 162 | S | 0.11 | | |
| 163 | V | 0.28 | | |
| 164 | T | 0.11 | | |
| 165 | E | 0.42 | | |
| 166 | Q | 0.04 | | |
| 167 | D | 0.27 | | DE |
| 168 | S | 0.36 | | DE |
| 169 | K | 0.79 | Interface w/ VL | DE |
| 170 | D | 0.38 | | DE |
| 171 | S | 0.03 | | |
| 172 | T | 0.04 | | |
| 173 | Y | 0.04 | | |
| 174 | S | 0.00 | | |
| 175 | L | 0.02 | | |
| 176 | S | 0.05 | | |
| 177 | S | 0.01 | | |
| 178 | T | 0.17 | | |
| 179 | L | 0.00 | | |
| 180 | T | 0.42 | | DE |
| 181 | L | 0.12 | | |
| 182 | S | 0.37 | | DE |
| 183 | K | 0.33 | | DE |
| 184 | A | 0.53 | | DE |
| 185 | D | 0.45 | | DE |
| 186 | Y | 0.05 | | |
| 187 | E | 0.46 | | DE |
| 188 | K | 0.65 | | DE |
| 189 | H | 0.30 | | |
| 190 | K | 0.44 | | DE |
| 191 | V | 0.35 | | DE |
| 192 | Y | 0.00 | | |
| 193 | A | 0.11 | | DE |
| 194 | C | 0.00 | | |
| 195 | E | 0.24 | | DE |
| 196 | V | 0.00 | | |
| 197 | T | 0.34 | | DE |
| 198 | H | 0.05 | | |
| 199 | Q | 0.66 | | DE |
| 200 | G | 0.37 | | DE |
| 201 | L | 0.16 | | |
| 202 | S | 0.98 | | DE |
| 203 | S | 0.55 | | DE |
| 204 | P | 0.51 | | |
| 205 | V | 0.26 | | |
| 206 | T | 0.50 | | DE |
| 207 | K | 0.36 | | DE |
| 208 | S | 0.50 | | DE |
| 209 | F | 0.14 | | |
| 210 | N | 0.30 | | DE |
| 211 | R | 0.26 | | DE |
| 212 | G | 0.97 | | DE |
| 213 | E | 0.91 | | DE |

Figure 3 (cont.)

| EU | Ckappa | Fraction Exposed | Notes | Subs |
|---|---|---|---|---|
| 214 | C | | | |

Figure 4

IgG1-CH1-pI(6) (SEQ ID NO: 7)

AETKGPSVFPLAPSSESTSGGTAALGCLVKDYFPEPVTVSWNSGALESGVHTFPAVLQS
SGLYSLSSVVTVPSSSLGTQTYICNVNHEPSDTEVDKKVEPKSCDKTHTCPPCPAPELLG
GPSVFLFPPKPKDTLMISRTPEVTCVVVDVSHEDPEVKFNWYVDGVEVHNAKTKPREEQ
YNSTYRVVSVLTVLHQDWLNGKEYKCKVSNKALPAPIEKTISKAKGQPREPQVYTLPPSR
EEMTKNQVSLTCLVKGFYPSDIAVEWESNGQPENNYKTTPPVLDSDGSFFLYSKLTVDK
SRWQQGNVFSCSVMHEALHNHYTQKSLSLSPGK

CK-pI(6) (SEQ ID NO: 8)

RTVAAPSVFIFPPSDEQLESGTASVVCLLNNFYPREAEVQWKVDDALQEGNSQESVTEQ
DSEDSTYSLSSTLTLSKADYEKHKVYACEVTHQGLESPVTKSFNRGEC

IgG1-CH1-pI(6)-434S (SEQ ID NO: 52)

AETKGPSVFPLAPSSESTSGGTAALGCLVKDYFPEPVTVSWNSGALESGVHTFPAVLQS
SGLYSLSSVVTVPSSSLGTQTYICNVNHEPSDTEVDKKVEPKSCDKTHTCPPCPAPELLG
GPSVFLFPPKPKDTLMISRTPEVTCVVVDVSHEDPEVKFNWYVDGVEVHNAKTKPREEQ
YNSTYRVVSVLTVLHQDWLNGKEYKCKVSNKALPAPIEKTISKAKGQPREPQVYTLPPSR
EEMTKNQVSLTCLVKGFYPSDIAVEWESNGQPENNYKTTPPVLDSDGSFFLYSKLTVDK
SRWQQGNVFSCSVMHEALHSHYTQKSLSLSPGK

IgG1-CH1-pI(6)-428L/434S (SEQ ID NO: 53)

AETKGPSVFPLAPSSESTSGGTAALGCLVKDYFPEPVTVSWNSGALESGVHTFPAVLQS
SGLYSLSSVVTVPSSSLGTQTYICNVNHEPSDTEVDKKVEPKSCDKTHTCPPCPAPELLG
GPSVFLFPPKPKDTLMISRTPEVTCVVVDVSHEDPEVKFNWYVDGVEVHNAKTKPREEQ
YNSTYRVVSVLTVLHQDWLNGKEYKCKVSNKALPAPIEKTISKAKGQPREPQVYTLPPSR
EEMTKNQVSLTCLVKGFYPSDIAVEWESNGQPENNYKTTPPVLDSDGSFFLYSKLTVDK
SRWQQGNVFSCSVLHEALHSHYTQKSLSLSPGK

Figure 5

Anti-VEGF VH (SEQ ID NO: 9)

EVQLVESGGGLVQPGGSLRLSCAASGYTFTNYGMNWVRQAPGKGLEWVGWINTYTGE
PTYAADFKRRFTFSLDTSKSTAYLQMNSLRAEDTAVYYCAKYPHYYGSSHWYFDVWGQ
GTLVTVSS

Anti-VEGF VL (SEQ ID NO: 10)

DIQMTQSPSSLSASVGDRVTITCSASQDISNYLNWYQQKPGKAPKVLIYFTSSLHSGVPS
RFSGSGSGTDFTLTISSLQPEDFATYYCQQYSTVPWTFGQGTKVEIK

Figure 6

Heavy chain of XENP9493_Bevacizumab-IgG1-CH1-pI(6)-CK-pI(6) (SEQ ID NO: 11)
EVQLVESGGGLVQPGGSLRLSCAASGYTFTNYGMNWVRQAPGKGLEWVGWINTYTGE
PTYAADFKRRFTFSLDTSKSTAYLQMNSLRAEDTAVYYCAKYPHYYGSSHWYFDVWGQ
GTLVTVSSAETKGPSVFPLAPSSESTSGGTAALGCLVKDYFPEPVTVSWNSGALESGVH
TFPAVLQSSGLYSLSSVVTVPSSSLGTQTYICNVNHEPSDTEVDKKVEPKSCDKTHTCPP
CPAPELLGGPSVFLFPPKPKDTLMISRTPEVTCVVVDVSHEDPEVKFNWYVDGVEVHNA
KTKPREEQYNSTYRVVSVLTVLHQDWLNGKEYKCKVSNKALPAPIEKTISKAKGQPREP
QVYTLPPSREEMTKNQVSLTCLVKGFYPSDIAVEWESNGQPENNYKTTPPVLDSDGSFF
LYSKLTVDKSRWQQGNVFSCSVMHEALHNHYTQKSLSLSPGK Light chain of XENP9493_Bevacizumab-IgG1-CH1-pI(6)-CK-pI(6) (SEQ ID NO: 12)
DIQMTQSPSSLSASVGDRVTITCSASQDISNYLNWYQQKPGKAPKVLIYFTSSLHSGVPS
RFSGSGSGTDFTLTISSLQPEDFATYYCQQYSTVPWTFGQGTKVEIKRTVAAPSVFIFPP
SDEQLESGTASVVCLLNNFYPREAEVQWKVDDALQEGNSQESVTEQDSEDSTYSLSST
LTLSKADYEKHKVYACEVTHQGLESPVTKSFNRGEC Lanes:
1 – Anti-VEGF IgG1-CH1-pI(6) + Cκ-WT (XENP9491)
2 – Anti-VEGF IgG1-CH1-WT + Cκ-pI(6) (XENP9492)
3 – Anti-VEGF IgG1-CH1-pI(6) + Cκ-pI(6) (XENP9493)
4 – Ladder Figure 9
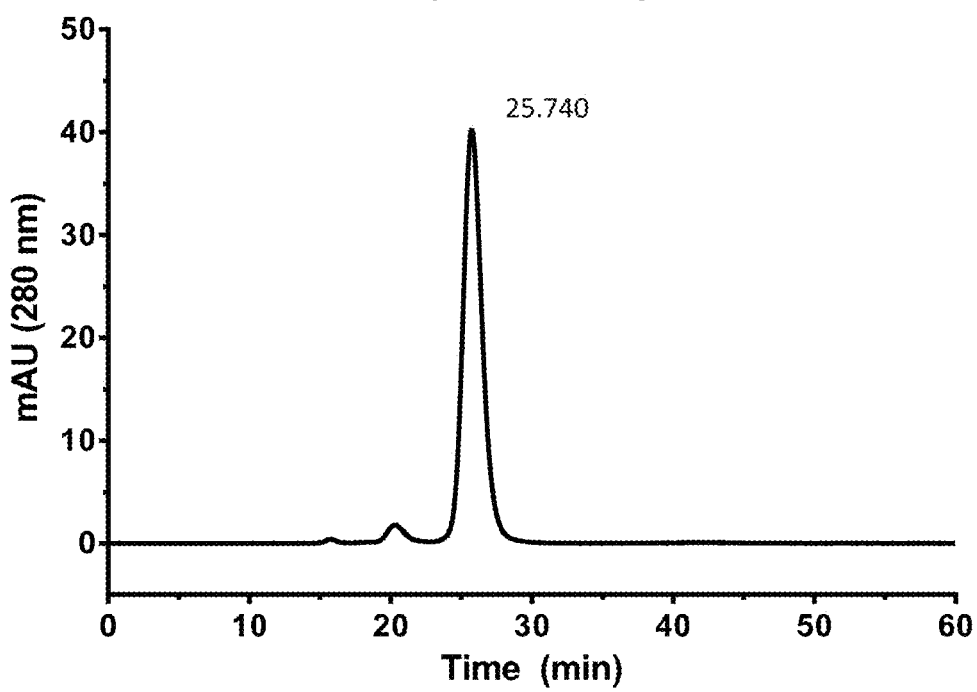
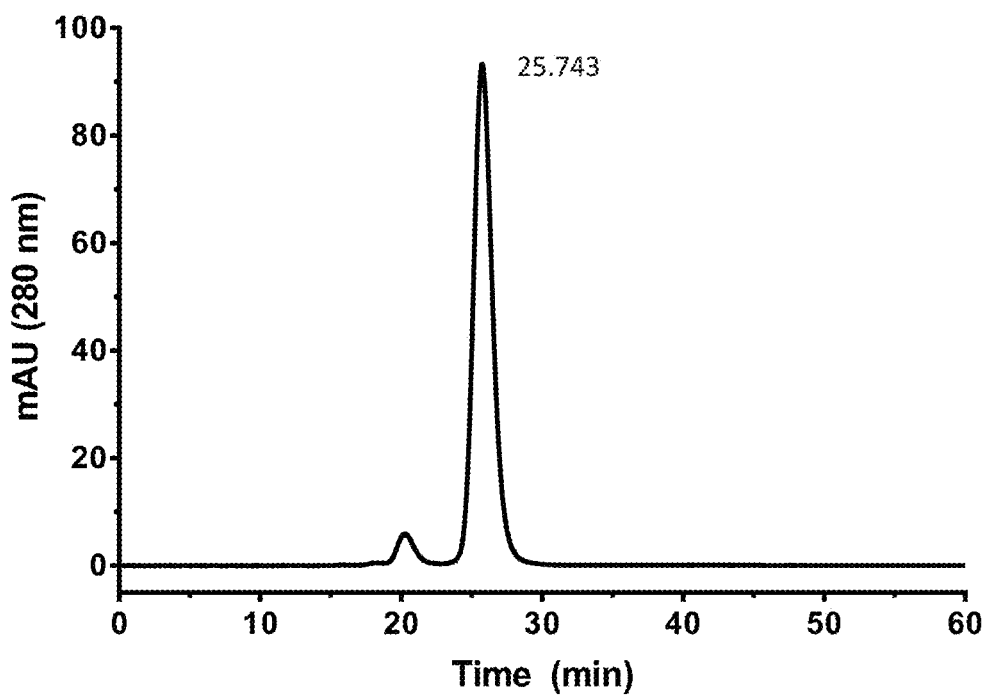

Figure 11
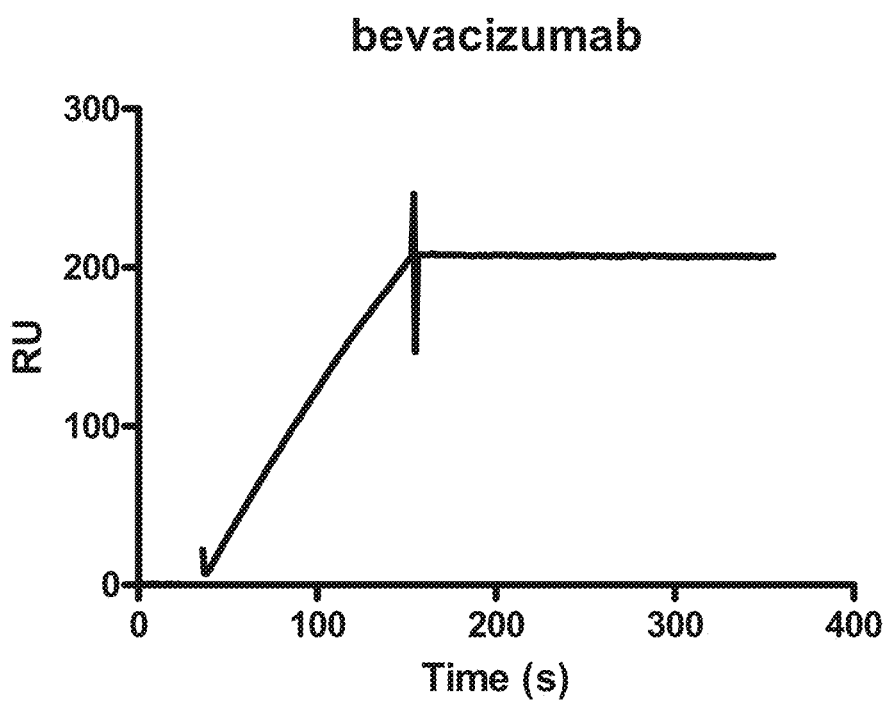
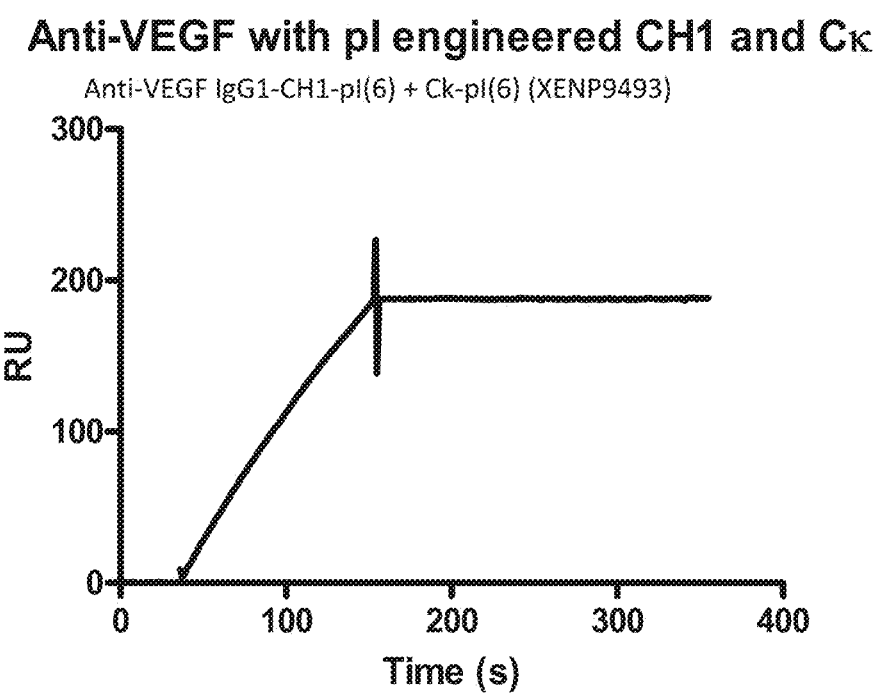

Figure 17

SEQ. ID NOS: 426-429

| EU Index | 118 | 119 | 120 | 121 | 122 | 123 | 124 | 125 | 126 | 127 | 128 | 129 | 130 | 131 | 132 | 133 | 134 | 135 | 136 | 137 | 138 |
|---|---|---|---|---|---|---|---|---|---|---|---|---|---|---|---|---|---|---|---|---|---|
| IgG1 | A | S | T | K | G | P | S | V | F | P | L | A | P | S | S | K | S | T | S | G | G |
| IgG2 | A | S | T | K | G | P | S | V | F | P | L | A | P | C | S | R | S | T | S | E | S |
| IgG3 | A | S | T | K | G | P | S | V | F | P | L | A | P | C | S | R | S | T | S | G | G |
| IgG4 | A | S | T | K | G | P | S | V | F | P | L | A | P | C | S | R | S | T | S | E | S |

| EU Index | 139 | 140 | 141 | 142 | 143 | 144 | 145 | 146 | 147 | 148 | 149 | 150 | 151 | 152 | 153 | 154 | 155 | 156 | 157 | 158 | 159 |
|---|---|---|---|---|---|---|---|---|---|---|---|---|---|---|---|---|---|---|---|---|---|
| IgG1 | T | A | A | L | G | C | L | V | K | D | Y | F | P | E | P | V | T | V | S | W | N |
| IgG2 | T | A | A | L | G | C | L | V | K | D | Y | F | P | E | P | V | T | V | S | W | N |
| IgG3 | T | A | A | L | G | C | L | V | K | D | Y | F | P | E | P | V | T | V | S | W | N |
| IgG4 | T | A | A | L | G | C | L | V | K | D | Y | F | P | E | P | V | T | V | S | W | N |

| EU Index | 160 | 161 | 162 | 163 | 164 | 165 | 166 | 167 | 168 | 169 | 170 | 171 | 172 | 173 | 174 | 175 | 176 | 177 | 178 | 179 | 180 |
|---|---|---|---|---|---|---|---|---|---|---|---|---|---|---|---|---|---|---|---|---|---|
| IgG1 | S | G | A | L | T | S | G | V | H | T | F | P | A | V | L | Q | S | S | G | L | Y |
| IgG2 | S | G | A | L | T | S | G | V | H | T | F | P | A | V | L | Q | S | S | G | L | Y |
| IgG3 | S | G | A | L | T | S | G | V | H | T | F | P | A | V | L | Q | S | S | G | L | Y |
| IgG4 | S | G | A | L | T | S | G | V | H | T | F | P | A | V | L | Q | S | S | G | L | Y |

| EU Index | 181 | 182 | 183 | 184 | 185 | 186 | 187 | 188 | 189 | 190 | 191 | 192 | 193 | 194 | 195 | 196 | 197 | 198 | 199 | 200 | 201 |
|---|---|---|---|---|---|---|---|---|---|---|---|---|---|---|---|---|---|---|---|---|---|
| IgG1 | S | L | S | S | V | V | T | V | P | S | S | S | L | G | T | Q | T | Y | I | C | N |
| IgG2 | S | L | S | S | V | V | T | V | P | S | S | N | F | G | T | Q | T | Y | T | C | N |
| IgG3 | S | L | S | S | V | V | T | V | P | S | S | S | L | G | T | Q | T | Y | T | C | N |
| IgG4 | S | L | S | S | V | V | T | V | P | S | S | S | L | G | T | K | T | Y | T | C | N |

| EU Index | 202 | 203 | 204 | 205 | 206 | 207 | 208 | 209 | 210 | 211 | 212 | 213 | 214 | 215 | 216 | 217 | 218 | 219 | 220 |
|---|---|---|---|---|---|---|---|---|---|---|---|---|---|---|---|---|---|---|---|
| IgG1 | V | N | H | K | P | S | N | T | K | V | D | K | K/R | V | E | P | K | S | C |
| IgG2 | V | D | H | K | P | S | N | T | K | V | D | K | T | V | E | P | K | C | C |
| IgG3 | V | N | H | K | P | S | N | T | K | V | D | K | R | V | E | R | K | T | P |
| IgG4 | V | D | H | K | P | S | N | T | K | V | D | K | R | V | E | S | K | Y | G |

Figure 17 (continued)

SEQ. ID NOS: 426-429

| EU Index | 221 | 222 | 223 | 224 | 225 | 226 | 227 | 228 |
|---|---|---|---|---|---|---|---|---|
| IgG1 | D | K | T | H | T | C | P | P |
| IgG2 | | | | V | E | C | P | P |
| IgG3 | L | G | D | T | T | C | P | R |
| IgG4 | | | | | P | C | P | S |

| EU Index | | | | | | | | |
|---|---|---|---|---|---|---|---|---|
| IgG1 | | | | | | | | |
| IgG2 | | | | | | | | |
| IgG3 | P | C | P | R | C | P | E | P |
| IgG4 | | | | | | | | |

| EU Index | | | | | | | | |
|---|---|---|---|---|---|---|---|---|
| IgG1 | E | P | K | S | C | D | T | P |
| IgG2 | | | | | | | | |
| IgG3 | E | P | K | S | C | D | T | P |
| IgG4 | | | | | | | | |

| EU Index | 229 | 230 | 231 | 232 | 233 | 234 | 235 | 236 |
|---|---|---|---|---|---|---|---|---|
| IgG1 | C | P | A | P | E | L | L | G |
| IgG2 | C | P | A | P | P | V | A | |
| IgG3 | C | P | R | C | P | | | |
| IgG4 | C | P | A | P | E | L | L | G |

| EU Index | | | | | | | | |
|---|---|---|---|---|---|---|---|---|
| IgG1 | | | | | | | | |
| IgG2 | | | | | | | | |
| IgG3 | E | P | K | S | C | D | T | P |
| IgG4 | E | F | L | G | | | | |

| EU Index | 237 | 238 | 239 | 240 | 241 | 242 | 243 | 244 | 245 | 246 | 247 | 248 | 249 | 250 | 251 | 252 | 253 | 254 | 255 | 256 | 257 |
|---|---|---|---|---|---|---|---|---|---|---|---|---|---|---|---|---|---|---|---|---|---|
| IgG1 | G | P | S | V | F | L | F | P | P | K | P | K | D | T | L | M | I | S | R | T | P |
| IgG2 | G | P | S | V | F | L | F | P | P | K | P | K | D | T | L | M | I | S | R | T | P |
| IgG3 | G | P | S | V | F | L | F | P | P | K | P | K | D | T | L | M | I | S | R | T | P |
| IgG4 | G | P | S | V | F | L | F | P | P | K | P | K | D | T | L | M | I | S | R | T | P |

Figure 17 (continued)

| EU Index | 258 | 259 | 260 | 261 | 262 | 263 | 264 | 265 | 266 | 267 | 268 | 269 | 270 | 271 | 272 | 273 | 274 | 275 | 276 | 277 | 278 |
|---|---|---|---|---|---|---|---|---|---|---|---|---|---|---|---|---|---|---|---|---|---|
| IgG1 | E | V | T | C | V | V | V | D | V | S | H | E | D | P | E | V | K | F | N | W | Y |
| IgG2 | E | V | T | C | V | V | V | D | V | S | H | E | D | P | E | V | Q | F | N | W | Y |
| IgG3 | E | V | T | C | V | V | V | D | V | S | H | E | D | P | E | V | Q | F | K | W | Y |
| IgG4 | E | V | T | C | V | V | V | D | V | S | Q | E | D | P | E | V | Q | F | N | W | Y |

| EU Index | 279 | 280 | 281 | 282 | 283 | 284 | 285 | 286 | 287 | 288 | 289 | 290 | 291 | 292 | 293 | 294 | 295 | 296 | 297 | 298 | 299 |
|---|---|---|---|---|---|---|---|---|---|---|---|---|---|---|---|---|---|---|---|---|---|
| IgG1 | V | D | G | V | E | V | H | N | A | K | T | K | P | R | E | E | Q | Y | N | S | T |
| IgG2 | V | D | G | V/M | E | V | H | N | A | K | T | K | P | R | E | E | Q | F | N | S | T |
| IgG3 | V | D | G | V | E | V | H | N | A | K | T | K | P | R | E | E | Q | Y | N | S | T |
| IgG4 | V | D | G | V | E | V | H | N | A | K | T | K | P | R | E | E | Q | F | N | S | T |

| EU Index | 300 | 301 | 302 | 303 | 304 | 305 | 306 | 307 | 308 | 309 | 310 | 311 | 312 | 313 | 314 | 315 | 316 | 317 | 318 | 319 | 320 |
|---|---|---|---|---|---|---|---|---|---|---|---|---|---|---|---|---|---|---|---|---|---|
| IgG1 | Y | R | V | V | S | V | L | T | V | L | H | Q | D | W | L | N | G | K | E | Y | K |
| IgG2 | F | R | V | V | S | V | L | T | V | V | H | Q | D | W | L | N | G | K | E | Y | K |
| IgG3 | F | R | V | V | S | V | L | T | V | L | H | Q | D | W | L | N | G | K | E | Y | K |
| IgG4 | Y | R | V | V | S | V | L | T | V | L | H | Q | D | W | L | N | G | K | E | Y | K |

| EU Index | 321 | 322 | 323 | 324 | 325 | 326 | 327 | 328 | 329 | 330 | 331 | 332 | 333 | 334 | 335 | 336 | 337 | 338 | 339 | 340 |
|---|---|---|---|---|---|---|---|---|---|---|---|---|---|---|---|---|---|---|---|---|
| IgG1 | C | K | V | S | N | K | A | L | P | A | P | I | E | K | T | I | S | K | A | K |
| IgG2 | C | K | V | S | N | K | G | L | P | A | P | I | E | K | T | I | S | K | T | K |
| IgG3 | C | K | V | S | N | K | A | L | P | A | P | I | E | K | T | I | S | K | T | K |
| IgG4 | C | K | V | S | N | K | G | L | P | S | S | I | E | K | T | I | S | K | A | K |

| EU Index | 341 | 342 | 343 | 344 | 345 | 346 | 347 | 348 | 349 | 350 | 351 | 352 | 353 | 354 | 355 | 356 | 357 | 358 | 359 | 360 | 361 |
|---|---|---|---|---|---|---|---|---|---|---|---|---|---|---|---|---|---|---|---|---|---|
| IgG1 | G | Q | P | R | E | P | Q | V | Y | T | L | P | P | S | R | D/E | E | L/M | T | K | N |
| IgG2 | G | Q | P | R | E | P | Q | V | Y | T | L | P | P | S | R | E | E | M | T | K | N |
| IgG3 | G | Q | P | R | E | P | Q | V | Y | T | L | P | P | S | R | E | E | M | T | K | N |
| IgG4 | G | Q | P | R | E | P | Q | V | Y | T | L | P | P | S | Q | E | E | M | T | K | N |

SEQ. ID NOS: 426-429

Figure 17 (continued)

| EU Index | 362 | 363 | 364 | 365 | 366 | 367 | 368 | 369 | 370 | 371 | 372 | 373 | 374 | 375 | 376 | 377 | 378 | 379 | 380 | 381 | 382 |
|---|---|---|---|---|---|---|---|---|---|---|---|---|---|---|---|---|---|---|---|---|---|
| IgG1 | Q | V | S | L | T | C | L | V | K | G | F | Y | P | S | D | I | A | V | E | W | E |
| IgG2 | Q | V | S | L | T | C | L | V | K | G | F | Y | P | S | D | I | A | V | E | W | E |
| IgG3 | Q | V | S | L | T | C | L | V | K | G | F | Y | P | S | D | I | A | V | E | W | E |
| IgG4 | Q | V | S | L | T | C | L | V | K | G | F | Y | P | S | D | I | A | V | E | W | E |

| EU Index | 383 | 384 | 385 | 386 | 387 | 388 | 389 | 390 | 391 | 392 | 393 | 394 | 395 | 396 | 397 | 398 | 399 | 400 | 401 | 402 | 403 |
|---|---|---|---|---|---|---|---|---|---|---|---|---|---|---|---|---|---|---|---|---|---|
| IgG1 | S | N | G | Q | P | E | N | N | Y | K | T | T | P | P | V | L | D | S | D | G | S |
| IgG2 | S | N | G | Q | P | E | N | N | Y | K | T | T | P | P | M | L | D | S | D | G | S |
| IgG3 | S | S | G | Q | P | E | N | N | Y | K | T | T | P | P | M | L | D | S | D | G | S |
| IgG4 | S | N | G | Q | P | E | N | N | Y | K | T | T | P | P | V | L | D | S | D | G | S |

| EU Index | 404 | 405 | 406 | 407 | 408 | 409 | 410 | 411 | 412 | 413 | 414 | 415 | 416 | 417 | 418 | 419 | 420 | 421 | 422 | 423 | 424 |
|---|---|---|---|---|---|---|---|---|---|---|---|---|---|---|---|---|---|---|---|---|---|
| IgG1 | F | F | L | Y | S | K | L | T | V | D | K | S | R | W | Q | Q | G | N | V | F | S |
| IgG2 | F | F | L | Y | S | K | L | T | V | D | K | S | R | W | Q | Q | G | N | V | F | S |
| IgG3 | F | F | L | Y | S | K | L | T | V | D | K | S | R | W | Q | Q | G | N | I | F | S |
| IgG4 | F | F | L | Y | S | R | L | T | V | D | K | S | R | W | Q | E | G | N | V | F | S |

| EU Index | 425 | 426 | 427 | 428 | 429 | 430 | 431 | 432 | 433 | 434 | 435 | 436 | 437 | 438 | 439 | 440 | 441 | 442 | 443 | 444 | 445 |
|---|---|---|---|---|---|---|---|---|---|---|---|---|---|---|---|---|---|---|---|---|---|
| IgG1 | C | S | V | M | H | E | A/G | L | H | N | H | Y | T | Q | K | S | L | S | L | S | P |
| IgG2 | C | S | V | M | H | E | A | L | H | N | H | Y | T | Q | K | S | L | S | L | S | P |
| IgG3 | C | S | V | M | H | E | A | L | H | N | R | F | T | Q | K | S | L | S | L | S | P |
| IgG4 | C | S | V | M | H | E | A | L | H | N | H | Y | T | Q | K | S | L | S | L | S | L |

| EU Index | 446 | 447 |
|---|---|---|
| IgG1 | G | K | D |
| IgG2 | G | K | E |
| IgG3 | G | K | D |
| IgG4 | G | K | E |

SEQ. ID NOS: 426-429

Figure 18

| SEQ ID NO. | | EU Index | 108 | 109 | 110 | 111 | 112 | 113 | 114 | 115 | 116 | 117 | 118 | 119 | 120 | 121 | 122 | 123 | 124 | 125 |
|---|---|---|---|---|---|---|---|---|---|---|---|---|---|---|---|---|---|---|---|---|
| 443 | | Cκ | R | T | V | A | A | P | S | V | F | I | F | P | P | S | D | E | Q | L |
| 444 | | Cλ | Q | P | K | A | A | P | S | V | T | L | F | P | P | S | S | E | E | L |

| | | EU Index | 126 | 127 | 128 | 129 | 130 | 131 | 132 | 133 | 134 | 135 | 136 | 137 | 138 | 139 | 140 | 141 | 142 | 143 |
|---|---|---|---|---|---|---|---|---|---|---|---|---|---|---|---|---|---|---|---|---|
| | | Cκ | K | S | G | T | A | S | V | V | C | L | L | N | N | F | Y | P | R | E |
| | | Cλ | Q | A | N | K | A | T | L | V | C | L | I | S | D | F | Y | P | G | A |

| | | EU Index | 144 | 145 | 146 | 147 | 148 | 149 | 150 | 151 | 152 | 153 | | 154 | 155 | 156 | 157 | 158 | 159 | 160 |
|---|---|---|---|---|---|---|---|---|---|---|---|---|---|---|---|---|---|---|---|---|
| | | Cκ | A | K | V | Q | W | K | V | D | N | A | | L | Q | S | G | N | S | Q |
| | | Cλ | V | T | V | A | W | K | A | D | S | S | P | V | K | A | G | | | V |

| | | EU Index | 161 | 162 | 163 | 164 | 165 | 166 | 167 | 168 | 169 | 170 | 171 | 172 | 173 | 174 | 175 | 176 | 177 | 178 |
|---|---|---|---|---|---|---|---|---|---|---|---|---|---|---|---|---|---|---|---|---|
| | | Cκ | E | S | V | T | E | Q | D | S | K | D | S | T | Y | S | L | S | S | T |
| | | Cλ | E | T | T | T | P | S | K | Q | S | N | N | K | Y | A | A | S | S | Y |

| | | EU Index | 179 | 180 | 181 | 182 | 183 | 184 | 185 | 186 | 187 | 188 | 189 | 190 | 191 | 192 | 193 | 194 | 195 | 196 |
|---|---|---|---|---|---|---|---|---|---|---|---|---|---|---|---|---|---|---|---|---|
| | | Cκ | L | T | L | S | K | A | D | Y | E | K | H | K | V | Y | A | C | E | V |
| | | Cλ | L | S | L | T | P | E | Q | W | K | S | H | R | S | Y | S | C | Q | V |

| | | EU Index | 197 | 198 | 199 | 200 | 201 | 202 | 203 | 204 | 205 | 206 | 207 | 208 | 209 | 210 | 211 | 212 | 213 | 214 | SEQ ID NO. |
|---|---|---|---|---|---|---|---|---|---|---|---|---|---|---|---|---|---|---|---|---|---|
| | | Cκ | T | H | Q | G | L | S | S | P | V | T | K | S | F | N | R | G | E | C | 443 |
| | | Cλ | T | H | E | G | | S | T | V | E | K | T | V | A | P | T | E | C | | 444 |

Figure 19

IgG1-WT (SEQ ID NO: 405)
ASTKGPSVFPLAPSSKSTSGGTAALGCLVKDYFPEPVTVSWNSGALTSGVHTFPAVLQS
SGLYSLSSVVTVPSSSLGTQTYICNVNHKPSNTKVDKKVEPKSCDKTHTCPPCPAPELLG
GPSVFLFPPKPKDTLMISRTPEVTCVVVDVSHEDPEVKFNWYVDGVEVHNAKTKPREEQ
YNSTYRVVSVLTVLHQDWLNGKEYKCKVSNKALPAPIEKTISKAKGQPREPQVYTLPPSR
EEMTKNQVSLTCLVKGFYPSDIAVEWESNGQPENNYKTTPPVLDSDGSFFLYSKLTVDK
SRWQQGNVFSCSVMHEALHNHYTQKSLSLSPGK

IgG2-WT (SEQ ID NO: 406)
ASTKGPSVFPLAPCSRSTSESTAALGCLVKDYFPEPVTVSWNSGALTSGVHTFPAVLQS
SGLYSLSSVVTVPSSNFGTQTYTCNVDHKPSNTKVDKTVERKCCVECPPCPAPPVAGPS
VFLFPPKPKDTLMISRTPEVTCVVVDVSHEDPEVQFNWYVDGVEVHNAKTKPREEQFNS
TFRVVSVLTVVHQDWLNGKEYKCKVSNKGLPAPIEKTISKTKGQPREPQVYTLPPSREE
MTKNQVSLTCLVKGFYPSDIAVEWESNGQPENNYKTTPPMLDSDGSFFLYSKLTVDKSR
WQQGNVFSCSVMHEALHNHYTQKSLSLSPGK pI-iso1 (SEQ ID NO: 13)
ASTKGPSVFPLAPSSKSTSESTAALGCLVKDYFPEPVTVSWNSGALTSGVHTFPAVLQS
SGLYSLSSVVTVPSSSLGTQTYTCNVDHKPSNTKVDKTVEPKSCDTTHTCPPCPAPELL
GGPSVFLFPPKPKDTLMISRTPEVTCVVVDVSQEDPEVQFNWYVDGVEVHNAKTKPRE
EQYNSTYRVVSVLTVLHQDWLNGKEYKCKVSNKALPAPIEKTISKAKGQPREPQVYTLPP
SQEEMTKNQVSLTCLVKGFYPSDIAVEWESSGQPENNYNTTPPMLDSDGSFFLYSKLTV
DKSRWQEGNVFSCSVMHEALHNHYTQKSLSLSPG pI-iso1(NF) (SEQ ID NO: 14)
ASTKGPSVFPLAPSSKSTSESTAALGCLVKDYFPEPVTVSWNSGALTSGVHTFPAVLQS
SGLYSLSSVVTVPSSNFGTQTYTCNVDHKPSNTKVDKTVEPKSCDTTHTCPPCPAPELL
GGPSVFLFPPKPKDTLMISRTPEVTCVVVDVSQEDPEVQFNWYVDGVEVHNAKTKPRE
EQYNSTYRVVSVLTVLHQDWLNGKEYKCKVSNKALPAPIEKTISKAKGQPREPQVYTLPP
SQEEMTKNQVSLTCLVKGFYPSDIAVEWESSGQPENNYNTTPPMLDSDGSFFLYSKLTV
DKSRWQEGNVFSCSVMHEALHNHYTQKSLSLSPG pI-iso1(NF-VE) (SEQ ID NO: 15)
ASTKGPSVFPLAPSSKSTSESTAALGCLVKDYFPEPVTVSWNSGALTSGVHTFPAVLQS
SGLYSLSSVVTVPSSNFGTQTYTCNVDHKPSNTKVDKTVEPKSCVECPPCPAPELLGGP
SVFLFPPKPKDTLMISRTPEVTCVVVDVSQEDPEVQFNWYVDGVEVHNAKTKPREEQYN
STYRVVSVLTVLHQDWLNGKEYKCKVSNKALPAPIEKTISKAKGQPREPQVYTLPPSQEE
MTKNQVSLTCLVKGFYPSDIAVEWESSGQPENNYNTTPPMLDSDGSFFLYSKLTVDKSR
WQEGNVFSCSVMHEALHNHYTQKSLSLSPG pI-iso1(NF-VE-DEDE) (SEQ ID NO:16)
ASTKGPSVFPLAPSSKSTSESTAALGCLVKDYFPEPVTVSWNSGALTSGVHTFPAVLQS
SGLYSLSSVVTVPSSNFGTQTYTCNVDHKPSNTKVDKTVEPKSCVECPPCPAPELLGGP
SVFLFPPKPKDTLMISRTPEVTCVVVDVSQEDPEVQFNWYVDGVEVHNAKTKPREEQYN
STYRVVSVLTVLHQDWLNGKEYKCKVSNKALPAPIEKTISKAKGQPREPQVYTLPPSQEE
MTKNQVSLTCLVKGFYPSDIAVEWESSGQPENNYNTTPPMLDSDGSFFLYSKLTVDKSR
WQEGNVFSCSVMHEALHNHYTQKSLSLSPGDEDE

Figure 19 (cont.)

Bevacizumab VH (SEQ ID NO: 407)
EVQLVESGGGLVQPGGSLRLSCAASGYTFTNYGMNWVRQAPGKGLEWVGWINTYTGE
PTYAADFKRRFTFSLDTSKSTAYLQMNSLRAEDTAVYYCAKYPHYYGSSHWYFDVWGQ
GTLVTVSS

IgG1-434S (SEQ ID NO: 50)
ASTKGPSVFPLAPSSKSTSGGTAALGCLVKDYFPEPVTVSWNSGALTSGVHTFPAVLQS
SGLYSLSSVVTVPSSSLGTQTYICNVNHKPSNTKVDKKVEPKSCDKTHTCPPCPAPELLG
GPSVFLFPPKPKDTLMISRTPEVTCVVVDVSHEDPEVKFNWYVDGVEVHNAKTKPREEQ
YNSTYRVVSVLTVLHQDWLNGKEYKCKVSNKALPAPIEKTISKAKGQPREPQVYTLPPSR
EEMTKNQVSLTCLVKGFYPSDIAVEWESNGQPENNYKTTPPVLDSDGSFFLYSKLTVDK
SRWQQGNVFSCSVMHEALHSHYTQKSLSLSPGK

IgG2-434S (SEQ ID NO: 51)
ASTKGPSVFPLAPCSRSTSESTAALGCLVKDYFPEPVTVSWNSGALTSGVHTFPAVLQS
SGLYSLSSVVTVPSSNFGTQTYTCNVDHKPSNTKVDKTVERKCC_V_E_CPPCPAPPV_
AGPSVFLFPPKPKDTLMISRTPEVTCVVVDVSHEDPEVQFNWYVDGVEVHNAKTKPREE
QFNSTFRVVSVLTVVHQDWLNGKEYKCKVSNKGLPAPIEKTISKTKGQPREPQVYTLPP
SREEMTKNQVSLTCLVKGFYPSDIAVEWESNGQPENNYKTTPPMLDSDGSFFLYSKLTV
DKSRWQQGNVFSCSVMHEALHSHYTQKSLSLSPGK

IgG1-pI(6)-Neutral-to-DE (SEQ ID NO: 55)
AETKGPSVFPLAPSSKSTSGGTAALGCLVKDYFPEPVTVSWNSGALESGVHTFPAVLQS
SGLYSLSSVVTVPSSSLGTQTYICNVNHKPSDTKVDKKVEPKSCDKTHTCPPCPAPELLG
GPSVFLFPPKPKDTLMISRTPEVTCVVVDVSHEDPEVKFNWYVDGVEVHNAKTKPREEQ
YNSTYRVVSVLTVLHQDWLNGKEYKCKVSNKALPAPIEKTISKAKGQPREPQVYTLPPSR
EEMTKNQVSLTCLVKGFYPSDIAVEWESNGQPENNYKTTPPVLDSDGSFFLYSKLTVDK
SRWQQGNVFSCSVMHEALHNHYTQKSLSLSPGK

IgG1-pI(6)-KR-to-Neutral (SEQ ID NO: 56)
ASTKGPSVFPLAPSSQSTSGGTAALGCLVKDYFPEPVTVSWNSGALTSGVHTFPAVLQS
SGLYSLSSVVTVPSSSLGTQTYICNVNHQPSNTQVDKKVEPKSCDKTHTCPPCPAPELL
GGPSVFLFPPKPKDTLMISRTPEVTCVVVDVSHEDPEVKFNWYVDGVEVHNAKTKPREE
QYNSTYRVVSVLTVLHQDWLNGKEYKCKVSNKALPAPIEKTISKAKGQPREPQVYTLPPS
REEMTKNQVSLTCLVKGFYPSDIAVEWESNGQPENNYKTTPPVLDSDGSFFLYSKLTVD
KSRWQQGNVFSCSVMHEALHNHYTQKSLSLSPGK

IgG1-pI(6)-KR-to-DE (SEQ ID NO: 57)
ASTKGPSVFPLAPSSESTSGGTAALGCLVKDYFPEPVTVSWNSGALTSGVHTFPAVLQS
SGLYSLSSVVTVPSSSLGTQTYICNVNHEPSNTEVDKKVEPKSCDKTHTCPPCPAPELLG
GPSVFLFPPKPKDTLMISRTPEVTCVVVDVSHEDPEVKFNWYVDGVEVHNAKTKPREEQ
YNSTYRVVSVLTVLHQDWLNGKEYKCKVSNKALPAPIEKTISKAKGQPREPQVYTLPPSR
EEMTKNQVSLTCLVKGFYPSDIAVEWESNGQPENNYKTTPPVLDSDGSFFLYSKLTVDK
SRWQQGNVFSCSVMHEALHNHYTQKSLSLSPGK

Figure 20

CK-WT (SEQ ID NO: 408)
RTVAAPSVFIFPPSDEQLKSGTASVVCLLNNFYPREAKVQWKVDNALQSGNSQESVTEQ
DSKDSTYSLSSTLTLSKADYEKHKVYACEVTHQGLSSPVTKSFNRGEC

CK-pI(3) (SEQ ID NO: 17)
RTVAAPSVFIFPPSDEQLESGTASVVCLLNNFYPREAEVQWKVDNALQSGNSQESVTEQ
DSEDSTYSLSSTLTLSKADYEKHKVYACEVTHQGLSSPVTKSFNRGEC

CK-pI(6) (SEQ ID NO: 409)
RTVAAPSVFIFPPSDEQLESGTASVVCLLNNFYPREAEVQWKVDDALQEGNSQESVTEQ
DSEDSTYSLSSTLTLSKADYEKHKVYACEVTHQGLESPVTKSFNRGEC

CK-pI(6-DEDE) (SEQ ID NO: 18)
RTVAAPSVFIFPPSDEQLESGTASVVCLLNNFYPREAEVQWKVDDALQEGNSQESVTEQ
DSEDSTYSLSSTLTLSKADYEKHKVYACEVTHQGLESPVTKSFNRGECDEDE

Bevacizumab VL (SEQ ID NO: 410)
DIQMTQSPSSLSASVGDRVTITCSASQDISNYLNWYQQKPGKAPKVLIYFTSSLHSGVPS
RFSGSGSGTDFTLTISSLQPEDFATYYCQQYSTVPWTFGQGTKVEIK

CK-Pi(3) (SEQ ID NO: 54)
RTVAAPSVFIFPPSDEQLESGTASVVCLLNNFYPREAEVQWKVDNALQSGNSQESVTEQ
DSEDSTYSLSSTLTLSKADYEKHKVYACEVTHQGLSSPVTKSFNRGEC

CK-N152D S156E S202E (SEQ ID NO: 58)
RTVAAPSVFIFPPSDEQLKSGTASVVCLLNNFYPREAKVQWKVDDALQEGNSQESVTEQ
DSKDSTYSLSSTLTLSKADYEKHKVYACEVTHQGLESPVTKSFNRGEC

CK-K126Q K145Q K169Q (SEQ ID NO: 59)
RTVAAPSVFIFPPSDEQLQSGTASVVCLLNNFYPREAQVQWKVDNALQSGNSQESVTE
QDSQDSTYSLSSTLTLSKADYEKHKVYACEVTHQGLSSPVTKSFNRGEC

CK-K126E K145E K169E (SEQ ID NO: 60)
RTVAAPSVFIFPPSDEQLESGTASVVCLLNNFYPREAEVQWKVDNALQSGNSQESVTEQ
DSEDSTYSLSSTLTLSKADYEKHKVYACEVTHQGLSSPVTKSFNRGEC

Figure 24

SEQ ID NOS: 418-422

CH1

| EU | 118 | 119 | 120 | 121 | 122 | 123 | 124 | 125 | 126 | 127 | 128 | 129 | 130 | 131 | 132 | 133 | 134 | 135 | 136 | 137 | 138 | 139 |
|---|---|---|---|---|---|---|---|---|---|---|---|---|---|---|---|---|---|---|---|---|---|---|
| pI-iso3 | A | S | T | K | G | P | S | V | F | P | L | A | P | S | S | K | S | T | S | E | S | T |
| IgG1 | A | S | T | K | G | P | S | V | F | P | L | A | P | S | S | K | S | T | S | G | G | T |
| IgG2 | A | S | T | K | G | P | S | V | F | P | L | A | P | C | S | R | S | T | S | E | S | T |
| IgG3 | A | S | T | K | G | P | S | V | F | P | L | A | P | C | S | R | S | T | S | G | G | T |
| IgG4 | A | S | T | K | G | P | S | V | F | P | L | A | P | C | S | R | S | T | S | E | S | T |

| EU | 140 | 141 | 142 | 143 | 144 | 145 | 146 | 147 | 148 | 149 | 150 | 151 | 152 | 153 | 154 | 155 | 156 | 157 | 158 | 159 | 160 | 161 |
|---|---|---|---|---|---|---|---|---|---|---|---|---|---|---|---|---|---|---|---|---|---|---|
| pI-iso3 | A | A | L | G | C | L | V | K | D | Y | F | P | E | P | V | T | V | S | W | N | S | G |
| IgG1 | A | A | L | G | C | L | V | K | D | Y | F | P | E | P | V | T | V | S | W | N | S | G |
| IgG2 | A | A | L | G | C | L | V | K | D | Y | F | P | E | P | V | T | V | S | W | N | S | G |
| IgG3 | A | A | L | G | C | L | V | K | D | Y | F | P | E | P | V | T | V | S | W | N | S | G |
| IgG4 | A | A | L | G | C | L | V | K | D | Y | F | P | E | P | V | T | V | S | W | N | S | G |

| EU | 162 | 163 | 164 | 165 | 166 | 167 | 168 | 169 | 170 | 171 | 172 | 173 | 174 | 175 | 176 | 177 | 178 | 179 | 180 | 181 | 182 | 183 |
|---|---|---|---|---|---|---|---|---|---|---|---|---|---|---|---|---|---|---|---|---|---|---|
| pI-iso3 | A | L | T | S | G | V | H | T | F | P | A | V | L | Q | S | S | G | L | Y | S | L | S |
| IgG1 | A | L | T | S | G | V | H | T | F | P | A | V | L | Q | S | S | G | L | Y | S | L | S |
| IgG2 | A | L | T | S | G | V | H | T | F | P | A | V | L | Q | S | S | G | L | Y | S | L | S |
| IgG3 | A | L | T | S | G | V | H | T | F | P | A | V | L | Q | S | S | G | L | Y | S | L | S |
| IgG4 | A | L | T | S | G | V | H | T | F | P | A | V | L | Q | S | S | G | L | Y | S | L | S |

| EU | 184 | 185 | 186 | 187 | 188 | 189 | 190 | 191 | 192 | 193 | 194 | 195 | 196 | 197 | 198 | 199 | 200 | 201 | 202 | 203 | 204 | 205 |
|---|---|---|---|---|---|---|---|---|---|---|---|---|---|---|---|---|---|---|---|---|---|---|
| pI-iso3 | S | V | V | T | V | P | S | S | N | F | G | T | Q | T | Y | T | C | N | V | D | H | K |
| IgG1 | S | V | V | T | V | P | S | S | L | G | T | Q | T | Y | I | C | N | V | N | H | K | |
| IgG2 | S | V | V | T | V | P | S | S | N | F | G | T | Q | T | Y | T | C | N | V | D | H | K |
| IgG3 | S | V | V | T | V | P | S | S | L | G | T | Q | T | Y | T | C | N | V | N | H | K | |
| IgG4 | S | V | V | T | V | P | S | S | L | G | T | K | T | Y | T | C | N | V | D | H | K | |

| EU | 206 | 207 | 208 | 209 | 210 | 211 | 212 | 213 | 214 | 215 | 216 | 217 | 218 | 219 | 220 |
|---|---|---|---|---|---|---|---|---|---|---|---|---|---|---|---|
| pI-iso3 | P | S | N | T | K | V | D | K | T | V | E | P | K | S | C |
| IgG1 | P | S | N | T | K | V | D | K | K/R | V | E | P | K | S | C |
| IgG2 | P | S | N | T | K | V | D | K | T | V | E | R | K | C | C |
| IgG3 | P | S | N | T | K | V | D | K | R | V | E | L | K | T | P |
| IgG4 | P | S | N | T | K | V | D | K | R | V | E | S | K | Y | G |

Hinge

| EU | | 221 | 222 | 223 | 224 | 225 | | | | | | | | | | | | | | |
|---|---|---|---|---|---|---|---|---|---|---|---|---|---|---|---|---|---|---|---|---|
| pI-iso3 | | D | T | T | H | T | | | | | | | | | | | | | | |
| IgG1 | | D | K | T | H | T | | | | | | | | | | | | | | |
| IgG2 | | | V | | E | | | | | | | | | | | | | | | |
| IgG3 | L | G | D | T | T | H | T | C | P | R | C | P | E | P | K | S | C | D | T | P | P | P |
| IgG4 | | | | | | P | P | | | | | | | | | | | | | |

| | | | | | | | | | | | | | | | | | | | | | |
|---|---|---|---|---|---|---|---|---|---|---|---|---|---|---|---|---|---|---|---|---|---|
| IgG3 | C | P | R | C | P | E | P | K | S | C | D | T | P | P | P | C | P | R | C | P | E | P |

| EU | | | | | | | 226 | 227 | 228 | 229 | 230 | 231 | 232 | 233 | 234 | 235 | 236 |
|---|---|---|---|---|---|---|---|---|---|---|---|---|---|---|---|---|---|
| pI-iso3 | | | | | | | C | P | P | C | P | A | P | E | L | L | G |
| IgG1 | | | | | | | C | P | P | C | P | A | P | E | L | L | G |
| IgG2 | | | | | | | C | P | P | C | P | A | P | P | V | A | |
| IgG3 | K | S | C | D | T | P | P | P | C | P | R | C | P | A | P | E | L | L | G |
| IgG4 | | | | | | | C | P | S | C | P | A | P | E | F | L | G |

SEQ ID NO: 418-422

| EU | 237 | 238 | 239 | 240 | 241 | 242 | 243 | 244 | 245 | 246 | 247 | 248 | 249 | 250 | 251 | 252 | 253 | 254 | 255 | 256 | 257 | 258 |
|---|---|---|---|---|---|---|---|---|---|---|---|---|---|---|---|---|---|---|---|---|---|---|
| pI-iso3 | G | P | S | V | F | L | F | P | P | K | P | K | D | T | L | M | I | S | R | T | P | E |
| IgG1 | G | P | S | V | F | L | F | P | P | K | P | K | D | T | L | M | I | S | R | T | P | E |
| IgG2 | G | P | S | V | F | L | F | P | P | K | P | K | D | T | L | M | I | S | R | T | P | E |
| IgG3 | G | P | S | V | F | L | F | P | P | K | P | K | D | T | L | M | I | S | R | T | P | E |
| IgG4 | G | P | S | V | F | L | F | P | P | K | P | K | D | T | L | M | I | S | R | T | P | E |

| EU | 259 | 260 | 261 | 262 | 263 | 264 | 265 | 266 | 267 | 268 | 269 | 270 | 271 | 272 | 273 | 274 | 275 | 276 | 277 | 278 | 279 | 280 |
|---|---|---|---|---|---|---|---|---|---|---|---|---|---|---|---|---|---|---|---|---|---|---|
| pI-iso3 | V | T | C | V | V | V | D | V | S | H | E | D | P | E | V | Q | F | N | W | Y | V | D |
| IgG1 | V | T | C | V | V | V | D | V | S | H | E | D | P | E | V | K | F | N | W | Y | V | D |
| IgG2 | V | T | C | V | V | V | D | V | S | H | E | D | P | E | V | Q | F | N | W | Y | V | D |
| IgG3 | V | T | C | V | V | V | D | V | S | H | E | D | P | E | V | Q | F | K | W | Y | V | D |
| IgG4 | V | T | C | V | V | V | D | V | S | Q | E | D | P | E | V | Q | F | N | W | Y | V | D |

| EU | 281 | 282 | 283 | 284 | 285 | 286 | 287 | 288 | 289 | 290 | 291 | 292 | 293 | 294 | 295 | 296 | 297 | 298 | 299 | 300 | 301 | 302 |
|---|---|---|---|---|---|---|---|---|---|---|---|---|---|---|---|---|---|---|---|---|---|---|
| pI-iso3 | G | V | E | V | H | N | A | K | T | K | P | R | E | E | Q | F | N | S | T | F | R | V |
| IgG1 | G | V | E | V | H | N | A | K | T | K | P | R | E | E | Q | Y | N | S | T | Y | R | V |
| IgG2 | G | V/M | E | V | H | N | A | K | T | K | P | R | E | E | Q | F | N | S | T | F | R | V |
| IgG3 | G | V | E | V | H | N | A | K | T | K | P | R | E | E | Q | Y | N | S | T | F | R | V |
| IgG4 | G | V | E | V | H | N | A | K | T | K | P | R | E | E | Q | F | N | S | T | Y | R | V |

| EU | 303 | 304 | 305 | 306 | 307 | 308 | 309 | 310 | 311 | 312 | 313 | 314 | 315 | 316 | 317 | 318 | 319 | 320 | 321 | 322 | 323 | 324 |
|---|---|---|---|---|---|---|---|---|---|---|---|---|---|---|---|---|---|---|---|---|---|---|
| pI-iso3 | V | S | V | L | T | V | V | H | Q | D | W | L | N | G | K | E | Y | K | C | K | V | S |
| IgG1 | V | S | V | L | T | V | L | H | Q | D | W | L | N | G | K | E | Y | K | C | K | V | S |
| IgG2 | V | S | V | L | T | V | V | H | Q | D | W | L | N | G | K | E | Y | K | C | K | V | S |
| IgG3 | V | S | V | L | T | V | L | H | Q | D | W | L | N | G | K | E | Y | K | C | K | V | S |
| IgG4 | V | S | V | L | T | V | L | H | Q | D | W | L | N | G | K | E | Y | K | C | K | V | S |

| EU | 325 | 326 | 327 | 328 | 329 | 330 | 331 | 332 | 333 | 334 | 335 | 336 | 337 | 338 | 339 | 340 |
|---|---|---|---|---|---|---|---|---|---|---|---|---|---|---|---|---|
| pI-iso3 | N | K | A | L | P | A | P | I | E | K | T | I | S | K | T | K |
| IgG1 | N | K | A | L | P | A | P | I | E | K | T | I | S | K | A | K |
| IgG2 | N | K | G | L | P | A | P | I | E | K | T | I | S | K | T | K |
| IgG3 | N | K | A | L | P | A | P | I | E | K | T | I | S | K | T | K |
| IgG4 | N | K | G | L | P | S | S | I | E | K | T | I | S | K | A | K |

SEQ ID NOS: 418-422

| EU | 341 | 342 | 343 | 344 | 345 | 346 | 347 | 348 | 349 | 350 | 351 | 352 | 353 | 354 | 355 | 356 | 357 | 358 | 359 | 360 | 361 | 362 |
|---|---|---|---|---|---|---|---|---|---|---|---|---|---|---|---|---|---|---|---|---|---|---|
| pl-iso3 | G | Q | P | R | E | P | Q | V | Y | T | L | P | P | S | Q | E | E | M | T | K | N | Q |
| IgG1 | G | Q | P | R | E | P | Q | V | Y | T | L | P | P | S | R | D/E | E | L/M | T | K | N | Q |
| IgG2 | G | Q | P | R | E | P | Q | V | Y | T | L | P | P | S | R | E | E | M | T | K | N | Q |
| IgG3 | G | Q | P | R | E | P | Q | V | Y | T | L | P | P | S | R | E | E | M | T | K | N | Q |
| IgG4 | G | Q | P | R | E | P | Q | V | Y | T | L | P | P | S | Q | E | E | M | T | K | N | Q |

| EU | 363 | 364 | 365 | 366 | 367 | 368 | 369 | 370 | 371 | 372 | 373 | 374 | 375 | 376 | 377 | 378 | 379 | 380 | 381 | 382 | 383 | 384 |
|---|---|---|---|---|---|---|---|---|---|---|---|---|---|---|---|---|---|---|---|---|---|---|
| pl-iso3 | V | S | L | T | C | L | V | K | G | F | Y | P | S | D | I | A | V | E | W | E | S | S |
| IgG1 | V | S | L | T | C | L | V | K | G | F | Y | P | S | D | I | A | V | E | W | E | S | N |
| IgG2 | V | S | L | T | C | L | V | K | G | F | Y | P | S | D | I | A | V | E | W | E | S | N |
| IgG3 | V | S | L | T | C | L | V | K | G | F | Y | P | S | D | I | A | V | E | W | E | S | S |
| IgG4 | V | S | L | T | C | L | V | K | G | F | Y | P | S | D | I | A | V | E | W | E | S | N |

| EU | 385 | 386 | 387 | 388 | 389 | 390 | 391 | 392 | 393 | 394 | 395 | 396 | 397 | 398 | 399 | 400 | 401 | 402 | 403 | 404 | 405 | 406 |
|---|---|---|---|---|---|---|---|---|---|---|---|---|---|---|---|---|---|---|---|---|---|---|
| pl-iso3 | G | Q | P | E | N | N | Y | N | T | T | P | P | M | L | D | S | D | G | S | F | F | L |
| IgG1 | G | Q | P | E | N | N | Y | K | T | T | P | P | V | L | D | S | D | G | S | F | F | L |
| IgG2 | G | Q | P | E | N | N | Y | K | T | T | P | P | M | L | D | S | D | G | S | F | F | L |
| IgG3 | G | Q | P | E | N | N | Y | N | T | T | P | P | M | L | D | S | D | G | S | F | F | L |
| IgG4 | G | Q | P | E | N | N | Y | K | T | T | P | P | V | L | D | S | D | G | S | F | F | L |

| EU | 407 | 408 | 409 | 410 | 411 | 412 | 413 | 414 | 415 | 416 | 417 | 418 | 419 | 420 | 421 | 422 | 423 | 424 | 425 | 426 | 427 | 428 |
|---|---|---|---|---|---|---|---|---|---|---|---|---|---|---|---|---|---|---|---|---|---|---|
| pl-iso3 | Y | S | K | L | T | V | D | K | S | R | W | Q | E | G | N | V | F | S | C | S | V | M |
| IgG1 | Y | S | K | L | T | V | D | K | S | R | W | Q | Q | G | N | V | F | S | C | S | V | M |
| IgG2 | Y | S | K | L | T | V | D | K | S | R | W | Q | Q | G | N | V | F | S | C | S | V | M |
| IgG3 | Y | S | K | L | T | V | D | K | S | R | W | Q | Q | G | N | I | F | S | C | S | V | M |
| IgG4 | Y | S | R | L | T | V | D | K | S | R | W | Q | E | G | N | V | F | S | C | S | V | M |

| EU | 429 | 430 | 431 | 432 | 433 | 434 | 435 | 436 | 437 | 438 | 439 | 440 | 441 | 442 | 443 | 444 | 445 | 446 | 447 |
|---|---|---|---|---|---|---|---|---|---|---|---|---|---|---|---|---|---|---|---|
| pl-iso3 | H | E | A | L | H | N | H | Y | T | Q | K | S | L | S | L | S | P | G | |
| IgG1 | H | E | A/G | L | H | N | H | Y | T | Q | K | S | L | S | L | S | P | G | K |
| IgG2 | H | E | A | L | H | N | H | Y | T | Q | K | S | L | S | L | S | P | G | K |
| IgG3 | H | E | A | L | H | N | R | F | T | Q | K | S | L | S | L | S | P | G | K |
| IgG4 | H | E | A | L | H | N | H | Y | T | Q | K | S | L | S | L | S | L | G | K |

SEQ ID NOS: 416-417

```
IgG1     DKTHTCPPCPAPELLG
pI_Iso3  DTTHTCPPCPAPELLG
```

DTTHT present in IgG3

*pI iso3-SL has 192S/193L

†pI-iso3-charges-only contains all pI lowering substitutions (e.g. N203D), but does not contain neighboring isotypic mutations (e.g. I199T) that do not affect charge.

Figure 27

SEQ ID NO: 423

| EU | 108 | 109 | 110 | 111 | 112 | 113 | 114 | 115 | 116 | 117 | 118 | 119 | 120 | 121 | 122 | 123 | 124 | 125 |
|---|---|---|---|---|---|---|---|---|---|---|---|---|---|---|---|---|---|---|
| C$_K$ | R | T | V | A | A | P | S | V | F | I | F | P | P | S | D | E | Q | L |

| EU | 126 | 127 | 128 | 129 | 130 | 131 | 132 | 133 | 134 | 135 | 136 | 137 | 138 | 139 | 140 | 141 | 142 | 143 |
|---|---|---|---|---|---|---|---|---|---|---|---|---|---|---|---|---|---|---|
| C$_K$ | *E* | S | G | T | A | S | V | V | C | L | L | N | N | F | Y | P | R | E |

| EU | 144 | 145 | 146 | 147 | 148 | 149 | 150 | 151 | 152 | 153 | 154 | 155 | 156 | 157 | 158 | 159 | 160 | |
|---|---|---|---|---|---|---|---|---|---|---|---|---|---|---|---|---|---|---|
| C$_K$ | A | *E* | V | Q | W | K | V | D | N | A | L | Q | S | G | N | S | Q | |

| EU | 161 | 162 | 163 | 164 | 165 | 166 | 167 | 168 | 169 | 170 | 171 | 172 | 173 | 174 | 175 | 176 | 177 | 178 |
|---|---|---|---|---|---|---|---|---|---|---|---|---|---|---|---|---|---|---|
| C$_K$ | E | S | V | T | E | Q | D | S | *E* | D | S | T | Y | S | L | S | S | T |

| EU | 179 | 180 | 181 | 182 | 183 | 184 | 185 | 186 | 187 | 188 | 189 | 190 | 191 | 192 | 193 | 194 | 195 | 196 |
|---|---|---|---|---|---|---|---|---|---|---|---|---|---|---|---|---|---|---|
| C$_K$ | L | T | L | S | K | A | D | Y | E | K | H | K | V | Y | A | C | E | V |

| EU | 197 | 198 | 199 | 200 | 201 | 202 | 203 | 204 | 205 | 206 | 207 | 208 | 209 | 210 | 211 | 212 | 213 | 214 |
|---|---|---|---|---|---|---|---|---|---|---|---|---|---|---|---|---|---|---|
| C$_K$ | T | H | Q | G | L | S | S | P | V | T | *E* | S | F | N | R | G | E | C |

Figure 28

IgG-pI-Iso2 (SEQ ID NO: 19)
ASTKGPSVFPLAPSSKSTSESTAALGCLVKDYFPEPVTVSWNSGALTSGVHTFPAVLQS
SGLYSLSSVVTVPSSNFGTQTYTCNVDHKPSNTKVDKTVEPKSCVECPPCPAPPVAGPS
VFLFPPKPKDTLMISRTPEVTCVVVDVSHEDPEVQFNWYVDGVEVHNAKTKPREEQFNS
TFRVVSVLTVVHQDWLNGKEYKCKVSNKGLPAPIEKTISKTKGQPREPQVYTLPPSQEE
MTKNQVSLTCLVKGFYPSDIAVEWESSGQPENNYNTTPPMLDSDGSFFLYSKLTVDKSR
WQEGNVFSCSVMHEALHNHYTQKSLSLSPG

IgG-pI-Iso2-434S (SEQ ID NO: 61)
ASTKGPSVFPLAPSSKSTSESTAALGCLVKDYFPEPVTVSWNSGALTSGVHTFPAVLQS
SGLYSLSSVVTVPSSNFGTQTYTCNVDHKPSNTKVDKTVEPKSCVECPPCPAPPVAGPS
VFLFPPKPKDTLMISRTPEVTCVVVDVSHEDPEVQFNWYVDGVEVHNAKTKPREEQFNS
TFRVVSVLTVVHQDWLNGKEYKCKVSNKGLPAPIEKTISKTKGQPREPQVYTLPPSQEE
MTKNQVSLTCLVKGFYPSDIAVEWESSGQPENNYNTTPPMLDSDGSFFLYSKLTVDKSR
WQEGNVFSCSVMHEALHSHYTQKSLSLSPG

IgG-pI-Iso2-SL-434S (SEQ ID NO: 65)
ASTKGPSVFPLAPSSKSTSESTAALGCLVKDYFPEPVTVSWNSGALTSGVHTFPAVLQS
SGLYSLSSVVTVPSSSLGTQTYTCNVDHKPSNTKVDKTVEPKSCVECPPCPAPPVAGPS
VFLFPPKPKDTLMISRTPEVTCVVVDVSHEDPEVQFNWYVDGVEVHNAKTKPREEQFNS
TFRVVSVLTVVHQDWLNGKEYKCKVSNKGLPAPIEKTISKTKGQPREPQVYTLPPSQEE
MTKNQVSLTCLVKGFYPSDIAVEWESSGQPENNYNTTPPMLDSDGSFFLYSKLTVDKSR
WQEGNVFSCSVMHEALHSHYTQKSLSLSPG

IgG-pI-Iso2-SL (SEQ ID NO: 20)
ASTKGPSVFPLAPSSKSTSESTAALGCLVKDYFPEPVTVSWNSGALTSGVHTFPAVLQS
SGLYSLSSVVTVPSSSLGTQTYTCNVDHKPSNTKVDKTVEPKSCVECPPCPAPPVAGPS
VFLFPPKPKDTLMISRTPEVTCVVVDVSHEDPEVQFNWYVDGVEVHNAKTKPREEQFNS
TFRVVSVLTVVHQDWLNGKEYKCKVSNKGLPAPIEKTISKTKGQPREPQVYTLPPSQEE
MTKNQVSLTCLVKGFYPSDIAVEWESSGQPENNYNTTPPMLDSDGSFFLYSKLTVDKSR
WQEGNVFSCSVMHEALHNHYTQKSLSLSPG

IgG-pI-Iso2-charges-only (SEQ ID NO: 21)
ASTKGPSVFPLAPSSKSTSEGTAALGCLVKDYFPEPVTVSWNSGALTSGVHTFPAVLQS
SGLYSLSSVVTVPSSSLGTQTYICNVDHKPSNTKVDKTVEPKSCVECPPCPAPPVAGPS
VFLFPPKPKDTLMISRTPEVTCVVVDVSHEDPEVQFNWYVDGVEVHNAKTKPREEQYNS
TYRVVSVLTVLHQDWLNGKEYKCKVSNKGLPAPIEKTISKAKGQPREPQVYTLPPSQEE
MTKNQVSLTCLVKGFYPSDIAVEWESNGQPENNYNTTPPVLDSDGSFFLYSKLTVDKSR
WQEGNVFSCSVMHEALHNHYTQKSLSLSPG

IgG-pI-Iso2-charges-only-434S (SEQ ID NO: 67)
ASTKGPSVFPLAPSSKSTSEGTAALGCLVKDYFPEPVTVSWNSGALTSGVHTFPAVLQS
SGLYSLSSVVTVPSSSLGTQTYICNVDHKPSNTKVDKTVEPKSCVECPPCPAPPVAGPS
VFLFPPKPKDTLMISRTPEVTCVVVDVSHEDPEVQFNWYVDGVEVHNAKTKPREEQYNS
TYRVVSVLTVLHQDWLNGKEYKCKVSNKGLPAPIEKTISKAKGQPREPQVYTLPPSQEE
MTKNQVSLTCLVKGFYPSDIAVEWESNGQPENNYNTTPPVLDSDGSFFLYSKLTVDKSR
WQEGNVFSCSVMHEALHSHYTQKSLSLSPG

IgG-pI-Iso3 (SEQ ID NO: 22)
ASTKGPSVFPLAPSSKSTSESTAALGCLVKDYFPEPVTVSWNSGALTSGVHTFPAVLQS
SGLYSLSSVVTVPSSNFGTQTYTCNVDHKPSNTKVDKTVEPKSCDTTHTCPPCPAPELL
GGPSVFLFPPKPKDTLMISRTPEVTCVVVDVSHEDPEVQFNWYVDGVEVHNAKTKPREE

Figure 28 (cont)

QFNSTFRVVSVLTVVHQDWLNGKEYKCKVSNKALPAPIEKTISKTKGQPREPQVYTLPPS
QEEMTKNQVSLTCLVKGFYPSDIAVEWESSGQPENNYNTTPPMLDSDGSFFLYSKLTVD
KSRWQEGNVFSCSVMHEALHNHYTQKSLSLSPG

IgG-pI-Iso3-434S (SEQ ID NO: 62)
ASTKGPSVFPLAPSSKSTSESTAALGCLVKDYFPEPVTVSWNSGALTSGVHTFPAVLQS
SGLYSLSSVVTVPSSNFGTQTYTCNVDHKPSNTKVDKTVEPKSCDTTHTCPPCPAPELL
GGPSVFLFPPKPKDTLMISRTPEVTCVVVDVSHEDPEVQFNWYVDGVEVHNAKTKPREE
QFNSTFRVVSVLTVVHQDWLNGKEYKCKVSNKALPAPIEKTISKTKGQPREPQVYTLPPS
QEEMTKNQVSLTCLVKGFYPSDIAVEWESSGQPENNYNTTPPMLDSDGSFFLYSKLTVD
KSRWQEGNVFSCSVMHEALHSHYTQKSLSLSPG

IgG-pI-Iso3-SL-434S (SEQ ID NO: 63)
ASTKGPSVFPLAPSSKSTSESTAALGCLVKDYFPEPVTVSWNSGALTSGVHTFPAVLQS
SGLYSLSSVVTVPSSSLGTQTYTCNVDHKPSNTKVDKTVEPKSCDTTHTCPPCPAPELL
GGPSVFLFPPKPKDTLMISRTPEVTCVVVDVSHEDPEVQFNWYVDGVEVHNAKTKPREE
QFNSTFRVVSVLTVVHQDWLNGKEYKCKVSNKALPAPIEKTISKTKGQPREPQVYTLPPS
QEEMTKNQVSLTCLVKGFYPSDIAVEWESSGQPENNYNTTPPMLDSDGSFFLYSKLTVD
KSRWQEGNVFSCSVMHEALHSHYTQKSLSLSPG

IgG-pI-Iso3-SL-428L/434S (SEQ ID NO: 64)
ASTKGPSVFPLAPSSKSTSESTAALGCLVKDYFPEPVTVSWNSGALTSGVHTFPAVLQS
SGLYSLSSVVTVPSSSLGTQTYTCNVDHKPSNTKVDKTVEPKSCDTTHTCPPCPAPELL
GGPSVFLFPPKPKDTLMISRTPEVTCVVVDVSHEDPEVQFNWYVDGVEVHNAKTKPREE
QFNSTFRVVSVLTVVHQDWLNGKEYKCKVSNKALPAPIEKTISKTKGQPREPQVYTLPPS
QEEMTKNQVSLTCLVKGFYPSDIAVEWESSGQPENNYNTTPPMLDSDGSFFLYSKLTVD
KSRWQEGNVFSCSVLHEALHSHYTQKSLSLSPG

IgG-pI-Iso3-SL (SEQ ID NO: 23)
ASTKGPSVFPLAPSSKSTSESTAALGCLVKDYFPEPVTVSWNSGALTSGVHTFPAVLQS
SGLYSLSSVVTVPSSSLGTQTYTCNVDHKPSNTKVDKTVEPKSCDTTHTCPPCPAPELL
GGPSVFLFPPKPKDTLMISRTPEVTCVVVDVSHEDPEVQFNWYVDGVEVHNAKTKPREE
QFNSTFRVVSVLTVVHQDWLNGKEYKCKVSNKALPAPIEKTISKTKGQPREPQVYTLPPS
QEEMTKNQVSLTCLVKGFYPSDIAVEWESSGQPENNYNTTPPMLDSDGSFFLYSKLTVD
KSRWQEGNVFSCSVMHEALHNHYTQKSLSLSPG

IgG-pI-Iso3-charges-only (SEQ ID NO: 24)
ASTKGPSVFPLAPSSKSTSEGTAALGCLVKDYFPEPVTVSWNSGALTSGVHTFPAVLQS
SGLYSLSSVVTVPSSSLGTQTYICNVDHKPSNTKVDKTVEPKSCDTTHTCPPCPAPELLG
GPSVFLFPPKPKDTLMISRTPEVTCVVVDVSHEDPEVQFNWYVDGVEVHNAKTKPREEQ
YNSTYRVVSVLTVLHQDWLNGKEYKCKVSNKALPAPIEKTISKAKGQPREPQVYTLPPSQ
EEMTKNQVSLTCLVKGFYPSDIAVEWESNGQPENNYNTTPPVLDSDGSFFLYSKLTVDK
SRWQEGNVFSCSVMHEALHNHYTQKSLSLSPG

IgG-pI-Iso3-charges-only-434S (SEQ ID NO: 66)
ASTKGPSVFPLAPSSKSTSEGTAALGCLVKDYFPEPVTVSWNSGALTSGVHTFPAVLQS
SGLYSLSSVVTVPSSSLGTQTYICNVDHKPSNTKVDKTVEPKSCDTTHTCPPCPAPELLG
GPSVFLFPPKPKDTLMISRTPEVTCVVVDVSHEDPEVQFNWYVDGVEVHNAKTKPREEQ
YNSTYRVVSVLTVLHQDWLNGKEYKCKVSNKALPAPIEKTISKAKGQPREPQVYTLPPSQ

Figure 28 (cont)

EEMTKNQVSLTCLVKGFYPSDIAVEWESNGQPENNYNTTPPVLDSDGSFFLYSKLTVDK
SRWQEGNVFSCSVMHEALHSHYTQKSLSLSPG

IgG1-pI(7) (SEQ ID NO: 25)
ASTKGPSVFPLAPSSESTSGGTAALGCLVKDYFPEPVTVSWNSGALTSGVHTFPAVLQS
SGLYSLSSVVTVPSSSLGTQTYICNVNHEPSNTEVDKKVEPKSCDKTHTCPPCPAPELLG
GPSVFLFPPKPKDTLMISRTPEVTCVVVDVSHEDPEVEFNWYVDGVEVHNAKTKPREEQ
YNSTYRVVSVLTVLHQDWLNGKEYKCKVSNKALPAPIEKTISKAKGQPREPQVYTLPPSE
EEMTKNQVSLTCLVKGFYPSDIAVEWESNGQPENNYETTPPVLDSDGSFFLYSKLTVDK
SRWQQGNVFSCSVMHEALHNHYTQKSLSLSPG

IgG1-pI(7)-434S (SEQ ID NO: 68)
ASTKGPSVFPLAPSSESTSGGTAALGCLVKDYFPEPVTVSWNSGALTSGVHTFPAVLQS
SGLYSLSSVVTVPSSSLGTQTYICNVNHEPSNTEVDKKVEPKSCDKTHTCPPCPAPELLG
GPSVFLFPPKPKDTLMISRTPEVTCVVVDVSHEDPEVEFNWYVDGVEVHNAKTKPREEQ
YNSTYRVVSVLTVLHQDWLNGKEYKCKVSNKALPAPIEKTISKAKGQPREPQVYTLPPSE
EEMTKNQVSLTCLVKGFYPSDIAVEWESNGQPENNYETTPPVLDSDGSFFLYSKLTVDK
SRWQQGNVFSCSVMHEALHSHYTQKSLSLSPG

IgG1-pI(11) (SEQ ID NO: 26)
ASTKGPSVFPLAPSSESTSGGTAALGCLVKDYFPEPVTVSWNSGALTSGVHTFPAVLQS
SGLYSLSSVVTVPSSSLGTQTYICNVNHEPSNTEVDKKVEPKSCDKTHTCPPCPAPELLG
GPSVFLFPPKPKDTLMISRTPEVTCVVVDVSHEDPEVEFNWYVDGVEVHNAKTKPREEQ
YNSTYRVVSVLTVLHQDWLNGKEYECEVSNEALPAPIEETISKAKGQPREPQVYTLPPSE
EEMTKNQVSLTCLVKGFYPSDIAVEWESNGQPENNYETTPPVLDSDGSFFLYSKLTVDK
SRWQQGNVFSCSVMHEALHNHYTQKSLSLSPG

IgG1/2-pI(7) (SEQ ID NO: 27)
ASTKGPSVFPLAPSSESTSGGTAALGCLVKDYFPEPVTVSWNSGALTSGVHTFPAVLQS
SGLYSLSSVVTVPSSSLGTQTYICNVNHEPSNTEVDKKVEPKSCDKTHTCPPCPAPPVA
GPSVFLFPPKPKDTLMISRTPEVTCVVVDVSHEDPEVEFNWYVDGVEVHNAKTKPREEQ
FNSTFRVVSVLTVVHQDWLNGKEYKCKVSNKGLPAPIEKTISKTKGQPREPQVYTLPPSE
EEMTKNQVSLTCLVKGFYPSDIAVEWESNGQPENNYETTPPMLDSDGSFFLYSKLTVDK
SRWQQGNVFSCSVMHEALHNHYTQKSLSLSPG

IgG1/2_pI(7)-434S (SEQ ID NO: 69)
ASTKGPSVFPLAPSSESTSGGTAALGCLVKDYFPEPVTVSWNSGALTSGVHTFPAVLQS
SGLYSLSSVVTVPSSSLGTQTYICNVNHEPSNTEVDKKVEPKSCDKTHTCPPCPAPPVA
GPSVFLFPPKPKDTLMISRTPEVTCVVVDVSHEDPEVEFNWYVDGVEVHNAKTKPREEQ
FNSTFRVVSVLTVVHQDWLNGKEYKCKVSNKGLPAPIEKTISKTKGQPREPQVYTLPPSE
EEMTKNQVSLTCLVKGFYPSDIAVEWESNGQPENNYETTPPMLDSDGSFFLYSKLTVDK
SRWQQGNVFSCSVMHEALHSHYTQKSLSLSPG

IgG1/2-pI(11) (SEQ ID NO: 28)
ASTKGPSVFPLAPSSESTSGGTAALGCLVKDYFPEPVTVSWNSGALTSGVHTFPAVLQS
SGLYSLSSVVTVPSSSLGTQTYICNVNHEPSNTEVDKKVEPKSCDKTHTCPPCPAPPVA
GPSVFLFPPKPKDTLMISRTPEVTCVVVDVSHEDPEVEFNWYVDGVEVHNAKTKPREEQ
FNSTFRVVSVLTVVHQDWLNGKEYECEVSNEGLPAPIEETISKTKGQPREPQVYTLPPSE
EEMTKNQVSLTCLVKGFYPSDIAVEWESNGQPENNYETTPPMLDSDGSFFLYSKLTVDK
SRWQQGNVFSCSVMHEALHNHYTQKSLSLSPG

Figure 28 (cont)

CK-pI(4) (SEQ ID NO: 29)
RTVAAPSVFIFPPSDEQLESGTASVVCLLNNFYPREAEVQWKVDNALQSGNSQESVTEQ
DSEDSTYSLSSTLTLSKADYEKHKVYACEVTHQGLSSPVTESFNRGEC

CK-Iso(3) (SEQ ID NO: 30)
QTVAAPSVFIFPPSDEQLQSGTASVVCLLNNFYPREAKVQWKVDNALQSGNSQESVTE
QDSKDSTYSLSSTLTLSKADYEKHKVYACEVTHEGLSSPVTKSFNRGEC

CK-Iso(4) (SEQ ID NO: 31)
QTVAAPSVFIFPPSDEQLQSGTASVVCLLNNFYPREATVQWKVDNALQSGNSQESVTEQ
DSKDSTYSLSSTLTLSKADYEKHKVYACEVTHEGLSSPVTKSFNRGEC

CK-Iso(5) (SEQ ID NO: 32)
QTVAAPSVFIFPPSDEELQSGTASVVCLLNNFYPREATVQWKVDNALQSGNSQESVTEQ
DSKDSTYSLSSTLTLSKADYEKHKVYACEVTHEGLSSPVTKSFNRGEC

CK-Iso(6) (SEQ ID NO: 33)
QTVAAPSVFIFPPSDEELQSGTASVVCLLNDFYPREATVQWKVDNALQSGNSQESVTEQ
DSKDSTYSLSSTLTLSKADYEKHKVYACEVTHEGLSSPVTKSFNRGEC

Figure 29

| Position | WT | fraction exposed (avg) | Delta E Glu (Avg) |
|---|---|---|---|
| 246 | K | 0.60 | -0.65 |
| 248 | K | 0.21 | -0.16 |
| 255 | R | 0.37 | 1.36 |
| 274 | K | 0.57 | -0.95 |
| 288 | K | 0.58 | -0.81 |
| 290 | K | 0.42 | -0.23 |
| 292 | R | 0.51 | 0.64 |
| 301 | R | 0.29 | 0.17 |
| 317 | K | 0.28 | 1.75 |
| 320 | K | 0.26 | -0.22 |
| 322 | K | 0.21 | -0.43 |
| 326 | K | 0.71 | -0.58 |
| 334 | K | 0.35 | -0.20 |
| 338 | K | 0.08 | 1.21 |
| 340 | K | 0.72 | -0.57 |
| 344 | R | 0.45 | 0.28 |
| 355 | R | 0.78 | -0.28 |
| 360 | K | 0.32 | -1.26 |
| 370 | K | 0.13 | -0.45 |
| 392 | K | 0.31 | 0.08 |
| 409 | K | 0.01 | 1.19 |
| 414 | K | 0.22 | 0.19 |
| 416 | R | 0.28 | 0.07 |
| 439 | K | 0.30 | -0.15 |

- Bevacizumab (IgG1-WT)         $t_{1/2} = 3.7 \pm 1.1$
- IgG2-434S                      $t_{1/2} = 14.4 \pm 1.3$
- IgG1-CH1-pI(6)-434S-CK-pI(6)   $t_{1/2} = 15.8 \pm 2.8$
- IgG-pI-Iso3-SL-434S-CK-WT      $t_{1/2} = 11.5 \pm 1.3$
- IgG-pI-Iso2-SL-434S-CK-WT      $t_{1/2} = 10.7 \pm 1.7$
- IgG-pI-Iso3-charges-only-434S-CK-WT  $t_{1/2} = 12.0 \pm 2.1$
- IgG-pI-Iso3-SL-434S-CK-Iso(5)  $t_{1/2} = 13.2 \pm 1.2$ ppa mbda

Figure 36

| AMINO ACID | pI |
|---|---|
| Alanine<br>Ala A | 6.00 |
| Arginine<br>Arg R | 11.15 |
| Asparagine<br>Asn N | 5.41 |
| Aspartic acid<br>Asp D | 2.77 |
| Cysteine<br>Cys C | 5.02 |
| Glutamic acid<br>Gln E | 3.22 |
| Glutamine<br>Gln Q | 5.65 |
| Glycine<br>Gly G | 5.97 |
| Histidine<br>His H | 7.47 |
| Isoleucine<br>Ile I | 5.94 |
| Leucine<br>Leu L | 5.98 |
| Lysine<br>Lys K | 9.59 |
| Methioinine<br>Met M | 5.74 |
| Phenylalanine<br>Phe F | 5.48 |
| Proline<br>Pro P | 6.30 |
| Serine<br>Ser S | 5.68 |
| Threonine<br>Thr T | 5.64 |
| Tryptophan<br>Trp W | 5.89 |
| Tyrosine<br>Tyr Y | 5.66 |
| Valine<br>Val V | 5.96 |

| XenP# | Name (HC) | SEQ ID NO (HC) | Name (LC) | SEQ ID NO (LC) | Calc. pI | # K/R | Delta K/R (vs. WT) | # D/E | Delta D/E (vs. WT) | Charge State | # HC Mutations vs IgG1 | # LC Mutations vs IgG1 | Total # of Mutations |
|---|---|---|---|---|---|---|---|---|---|---|---|---|---|
| | IgG-pI-Iso3 | 22 | CK-Iso(3) | 148 | 5.92 | 106 | -16 | 124 | 8 | -18 | 19 | 3 | 22 |
| | IgG-pI-Iso3 | 22 | CK-Iso(4) | 149 | 5.83 | 104 | -18 | 124 | 8 | -20 | 19 | 4 | 23 |
| | IgG-pI-Iso3 | 22 | CK-Iso(5) | 150 | 5.75 | 104 | -18 | 126 | 10 | -22 | 19 | 5 | 24 |
| | IgG-pI-Iso3 | 22 | CK-Iso(6) | 151 | 5.68 | 104 | -18 | 128 | 12 | -24 | 19 | 6 | 25 |
| XENP010327 | H3L0_IgG2_CH1_gG1_CH2_CH3 | 95 | any light chain | 199 | 7.30 | 120 | -2 | 120 | 4 | 0 | 19 | 0 | 19 |
| XENP010425 | IgG-pI-Iso3-charges-only | 24 | CK-WT | 152 | 6.20 | 110 | -12 | 122 | 6 | -12 | 9 | 0 | 9 |
| | IgG-pI-Iso2-charges-only | 21 | CK-WT | 152 | 6.27 | 110 | -12 | 120 | 4 | -16 | 10 | 0 | 10 |
| | H3L0_IgG2_CH1_gG1_Hinge_CH2_C H3 | 161 | any light chain | 200 | 7.67 | 122 | 0 | 122 | 4 | 2 | 9 | 0 | 9 |
| XENP010428 | IgG-pI-Iso23-SL-4345 | 96 | CK-WT | 152 | 6.20 | 110 | -12 | 122 | 6 | -12 | 19 | 0 | 19 |
| | IgG-pI-Iso3-SL-4345 | 97 | CK-WT | 152 | 6.20 | 110 | -12 | 122 | 6 | -12 | 19 | 0 | 19 |
| | H3L0_pI_Iso3_S13 8S/N195S/F193L 4345 | 162 | any light chain | 201 | 6.20 | 110 | -12 | 122 | 4 | -12 | 17 | 0 | 17 |
| XENP010468 | N434S | | | | | | | | | | | | |
| | H3L0_pI_Iso3_E13 7G/S139C/N192Y/ F193L N434S | 163 | any light chain | 202 | 6.31 | 110 | -12 | 120 | 4 | -10 | 18 | 0 | 18 |
| XENP010469 | IgG-pI-Iso2-SL | 23 | CK-WT | 152 | 6.27 | 110 | -12 | 120 | 4 | -18 | 26 | 0 | 26 |
| | IgG-pI-Iso2-SL-4345 | 98 | CK-WT | 152 | 6.27 | 110 | -12 | 120 | 4 | -18 | 27 | 0 | 27 |

Figure 37E

| XenP# | Name (HC) | SEQ ID NO (HC) | Name (LC) | SEQ ID NO (LC) | Calc. pI | # K,R | Delta K,R (vs. WT) | # D,E | Delta D,E (vs. WT) | Charge State | # HC Mutations vs IgG1 | # LC Mutations vs IgG1 | Total # of Mutations |
|---|---|---|---|---|---|---|---|---|---|---|---|---|---|
| | IgG-pI-Iso3-charges-only-4345 | 191 | Ck-WT | 152 | 6.20 | 118 | -12 | 122 | 0 | -12 | 10 | 0 | 10 |
| | IgG-pI-Iso2-charges-only-4345 | 192 | Ck-WT | 152 | 6.27 | 118 | -12 | 120 | 4 | -10 | 10 | 0 | 10 |
| XENP010474 | H3L0_IgG2_CH1_ gG1_CH2_CH3_N4 345 | 164 | any light chain | 203 | 7.30 | 120 | 0 | 120 | 4 | 0 | 17 | 0 | 17 |
| XENP010475 | H3L0_IgG2_CH1_ gG1_Hinge_CH2_C H3_N4345 | 165 | any light chain | 204 | 7.67 | 122 | 2 | 120 | 4 | 2 | 19 | 0 | 19 |
| XENP010476 | IgG3_pI(7)-4345 | 35 | Ck-pI(4) | 135 | 5.31 | 108 | -22 | 126 | 10 | -36 | 8 | 4 | 12 |
| XENP010477 | IgG1/2_pI(7)-4345 | 166 | Ck-pI(4) | 135 | 5.36 | 108 | -22 | 134 | 18 | -34 | 18 | 4 | 22 |
| XENP010478 | H3L0_pI_Iso1/2_c harges_only | 167 | any light chain | 205 | 6.27 | 118 | -12 | 122 | 4 | -10 | 23 | 0 | 23 |
| | IgG-pI-Iso3-SL-4345 | 23 | Ck-Iso(3) | 148 | 5.92 | 106 | -16 | 124 | 8 | -18 | 17 | 3 | 20 |
| | IgG-pI-Iso3-SL-4345 | 23 | Ck-Iso(4) | 149 | 5.83 | 104 | -18 | 124 | 8 | -20 | 17 | 4 | 21 |
| | IgG-pI-Iso3-SL-4345 | 23 | Ck-Iso(5) | 150 | 5.75 | 104 | -18 | 126 | 10 | -22 | 17 | 5 | 22 |
| | IgG-pI-Iso3-SL-4345 | 98 | Ck-Iso(3) | 148 | 5.92 | 106 | -16 | 124 | 8 | -18 | 18 | 3 | 21 |
| | IgG-pI-Iso3-SL-4345 | 98 | Ck-Iso(4) | 149 | 5.83 | 104 | -18 | 124 | 8 | -20 | 18 | 4 | 22 |
| | IgG-pI-Iso3-SL-4345 | 98 | Ck-Iso(5) | 150 | 5.75 | 104 | -18 | 126 | 10 | -22 | 18 | 5 | 23 |

Figure 37F

| XencP # | Name (HC) | SEQ ID NO (HC) | Name (LC) | SEQ ID NO (LC) | Calc. pI | # KR | Delta KR (vs. WT) | # DE | Delta DE (vs. WT) | Charge State | # HC Mutations vs IgG1 | # LC Mutations vs IgG1 | Total # of Mutations |
|---|---|---|---|---|---|---|---|---|---|---|---|---|---|
| | IgG-pI-Isc3-3L-428L/434S | 97 | Ck-Iso(3) | 148 | 5.92 | 106 | -16 | 124 | 8 | -18 | 18 | 3 | 22 |
| | IgG-pI-Isc3-3L-428L/434S | 97 | Ck-Iso(4) | 149 | 5.83 | 104 | -18 | 124 | 8 | -20 | 19 | 4 | 23 |
| | IgG-pI-Isc3-3L-428L/434S | 97 | Ck-Iso(5) | 150 | 5.75 | 104 | -18 | 126 | 10 | -22 | 19 | 5 | 24 |
| | IgG-pI-Isc3-3L-428L/434S | 98 | Ck-pI(4) | 149 | 5.54 | 102 | -20 | 130 | 14 | -28 | 18 | 4 | 22 |
| | IgG-pI-Isc3-4-434S | 99 | Ck-Iso(5) | 150 | 5.75 | 104 | -18 | 128 | 10 | -22 | 20 | 5 | 25 |
| | IgG-pI-Isc2-5L-434S | 99 | Ck-Iso(5) | 150 | 5.78 | 104 | -18 | 124 | 6 | -30 | 27 | 5 | 32 |

Figure 39

Heavy Chain 1 of XENP10653 (SEQ ID NO: 34)

EVQLVESGGGLVQPGGSLRLSCAASGYTFTNYGMNWVRQAPGKGLEWVGWINTYTGE
PTYAADFKRRFTFSLDTSKSTAYLQMNSLRAEDTAVYYCAKYPHYYGSSHWYFDVWGQ
GTLVTVSSASTKGPSVFPLAPSSKSTSGGTAALGCLVKDYFPEPVTVSWNSGALTSGVH
TFPAVLQSSGLYSLSSVVTVPSSSLGTQTYICNVNHKPSNTKVDKKVEPKSCDKTHTCPP
CPAPELLGGPSVFLFPPKPKDTLMISRTPEVTCVVVDVSHEDPEVKFNWYVDGVEVHNA
KTKPREEQYNSTYRVVSVLTVLHQDWLNGKEYKCKVSNKALPAPIEKTISKAKGQPREP
QVYTLPPSREEMTKNQVSLTCLVKGFYPSDIAVEWESNGQPENNYKTTPPVLDSDGSFF
LYSKLTVDKSRWQQGNVFSCSVMHEALHNHYTQKSLSLSPGK

Heavy Chain 2 of XENP10653 (SEQ ID NO: 35)

EVQLVESGGGLVQPGGSLRLSCAASGYTFTNYGMNWVRQAPGKGLEWVGWINTYTGE
PTYAADFKRRFTFSLDTSKSTAYLQMNSLRAEDTAVYYCAKYPHYYGSSHWYFDVWGQ
GTLVTVSSASTKGPSVFPLAPSSKSTSGGTAALGCLVKDYFPEPVTVSWNSGALESGVH
TFPAVLQSSGLYSLSSVVTVPSSSLGTQTYICNVNHKPSDTEVDKKVEPKSCDKTHTCPP
CPAPELLGGPSVFLFPPKPKDTLMISRTPEVTCVVVDVSHEDPEVQFNWYVDGVEVHNA
KTKPREEQYNSTYRVVSVLTVLHQDWLNGKEYKCKVSNKALPAPIEKTISKAKGQPREP
QVYTLPPSQEEMTKNQVSLTCLVKGFYPSDIAVEWESSGQPENNYNTTPPMLDSDGSF
FLYSKLTVDKSRWQEGNVFSCSVMHEALHNHYTQKSLSLSPG

Light Chain of XENP10653 (SEQ ID NO: 36)

DIQMTQSPSSLSASVGDRVTITCSASQDISNYLNWYQQKPGKAPKVLIYFTSSLHSGVPS
RFSGSGSGTDFTLTISSLQPEDFATYYCQQYSTVPWTFGQGTKVEIKRTVAAPSVFIFPP
SDEQLKSGTASVVCLLNNFYPREAKVQWKVDNALQSGNSQESVTEQDSKDSTYSLSST
LTLSKADYEKHKVYACEVTHQGLSSPVTKSFNRGEC

Heavy Chain 1 of anti-HER2 x anti-CD16 mAb-Fv (SEQ ID NO: 37)

EVQLVESGGGLVQPGGSLRLSCAASGFNIKDTYIHWVRQAPGKGLEWVARIYPTNGYTR
YADSVKGRFTISADTSKNTAYLQMNSLRAEDTAVYYCSRWGGDGFYAMDYWGQGTLV
TVSSASTKGPSVFPLAPSSKSTSGGTAALGCLVKDYFPEPVTVSWNSGALTSGVHTFPA
VLQSSGLYSLSSVVTVPSSSLGTQTYICNVNHKPSNTKVDKKVEPKSCDKTHTCPPCPA
PELLGGPSVFLFPPKPKDTLMISRTPEVTCVVVDVSHEDPEVKFNWYVDGVEVHNAKTK
PREEQYNSTYRVVSVLTVLHQDWLNGKEYKCKVSNKALPAPIEKTISKAKGQPREPQVC
TLPPSREEMTKNQVHLTCLVKGFYPSDIAVEWESNGQPENNYKTTPPVLDSDGSFALYS
KLTVDKSRWQQGNVFSCSVMHEALHNHYTQKSLSLSPGKSSDKTHTSPPSPGGGGSG
GGGSGGGGSGGGGQVTLKESGPGILQPSQTLSLTCSFSGFSLRTSGMGVGWIRQPSG
KGLEWLAHIWWDDDKRYNPALKSRLTISKDTSSNQVFLKIASVDTADTATYYCAQINPAW
FAYWGQGTLVTVSA

Heavy Chain 2 of anti-HER2 x anti-CD16 mAb-Fv (SEQ ID NO: 38)

EVQLVESGGGLVQPGGSLRLSCAASGFNIKDTYIHWVRQAPGKGLEWVARIYPTNGYTR
YADSVKGRFTISADTSKNTAYLQMNSLRAEDTAVYYCSRWGGDGFYAMDYWGQGTLV
TVSSASTKGPSVFPLAPSSKSTSGGTAALGCLVKDYFPEPVTVSWNSGALESGVHTFPA
VLQSSGLYSLSSVVTVPSSSLGTQTYICNVNHKPSDTEVDKKVEPKSCDKTHTCPPCPA
PELLGGPSVFLFPPKPKDTLMISRTPEVTCVVVDVSHEDPEVQFNWYVDGVEVHNAKTK
PREEQYNSTYRVVSVLTVLHQDWLNGKEYKCKVSNKALPAPIEKTISKAKGQPREPQVT

Figure 39 (Cont)

TLPPCQEEMTKNQVSLTCLVKGFYPSDIAVEWESSGQPENNYNTFPPMLDSDGSFFLYS
KLTVDKSRWQEGNVFSCSVMHEALHNHYTQKSLSLSPGKSSDKTHTSPPSPGGGGSG
GGGSGGGGSGGGGDIVLTQSPASLAVSLGQRATISCKASQSVDFDGDSFMNWYQQKP
GQPPKLLIYTTSNLESGIPARFSASGSGTDFTLNIHPVEEEDTATYYCQQSNEDPYTFGG
GTKLELK

Light Chain of anti-HER2 x anti-CD16 mAb-Fv (SEQ ID NO: 39)

DIQMTQSPSSLSASVGDRVTITCRASQDVNTAVAWYQQKPGKAPKLLIYSASFLYSGVPS
RFSGSRSGTDFTLTISSLQPEDFATYYCQQHYTTPPTFGQGTKVEIKRTVAAPSVFIFPPS
DEQLKSGTASVVCLLNNFYPREAKVQWKVDNALQSGNSQESVTEQDSKDSTYSLSSTL
TLSKADYEKHKVYACEVTHQGLSSPVTKSFNRGEC

Heavy Chain 1 of anti-CD19 x anti-CD16 mAb-Fv (SEQ ID NO: 40)

EVQLVESGGGLVKPGGSLKLSCAASGYTFTSYVMHWVRQAPGKGLEWIGYINPYNDGT
KYNEKFQGRVTISSDKSISTAYMELSSLRSEDTAMYYCARGTYYYGTRVFDYWGQTLV
TVSSASTKGPSVFPLAPSSKSTSGGTAALGCLVKDYFPEPVTVSWNSGALTSGVHTFPA
VLQSSGLYSLSSVVTVPSSSLGTQTYICNVNHKPSNTKVDKKVEPKSCDKTHTCPPCPA
PELLGGPSVFLFPPKPKDTLMISRTPEVTCVVVDVSHEDPEVKFNWYVDGVEVHNAKTK
PREEQYNSTYRVVSVLTVLHQDWLNGKEYKCKVSNKALPAPIEKTISKAKGQPREPQVC
TLPPSREEMTKNQVHLTCLVKGFYPSDIAVEWESNGQPENNYKTTPPVLDSDGSFALYS
KLTVDKSRWQQGNVFSCSVMHEALHNHYTQKSLSLSPGKSSDKTHTSPPSPGGGGSG
GGGSGGGGSGGGGQVTLKESGPGILQPSQTLSLTCSFSGFSLRTSGMGVGWIRQPSG
KGLEWLAHIWWDDDKRYNPALKSRLTISKDTSSNQVFLKIASVDTADTATYYCAQINPAW
FAYWGQGTLVTVSA

Heavy Chain 2 of anti-CD19 x anti-CD16 mAb-Fv (SEQ ID NO: 41)

EVQLVESGGGLVKPGGSLKLSCAASGYTFTSYVMHWVRQAPGKGLEWIGYINPYNDGT
KYNEKFQGRVTISSDKSISTAYMELSSLRSEDTAMYYCARGTYYYGTRVFDYWGQTLV
TVSSASTKGPSVFPLAPSSKSTSGGTAALGCLVKDYFPEPVTVSWNSGALESGVHTFPA
VLQSSGLYSLSSVVTVPSSSLGTQTYICNVNHKPSDTEVDKKVEPKSCDKTHTCPPCPA
PELLGGPSVFLFPPKPKDTLMISRTPEVTCVVVDVSHEDPEVQFNWYVDGVEVHNAKTK
PREEQYNSTYRVVSVLTVLHQDWLNGKEYKCKVSNKALPAPIEKTISKAKGQPREPQVT
TLPPCQEEMTKNQVSLTCLVKGFYPSDIAVEWESSGQPENNYNTFPPMLDSDGSFFLYS
KLTVDKSRWQEGNVFSCSVMHEALHNHYTQKSLSLSPGKSSDKTHTSPPSPGGGGSG
GGGSGGGGSGGGGDIVLTQSPASLAVSLGQRATISCKASQSVDFDGDSFMNWYQQKP
GQPPKLLIYTTSNLESGIPARFSASGSGTDFTLNIHPVEEEDTATYYCQQSNEDPYTFGG
GTKLELK

Light Chain of anti-CD19 x anti-CD16 mAb-Fv (SEQ ID NO:42)

DIVMTQSPATLSLSPGERATLSCRSSKSLQNVNGNTYLYWFQQKPGQSPQLLIYRMSNL
NSGVPDRFSGSGSGTEFTLTISSLEPEDFAVYYCMQHLEYPITFGAGTKLEIKRTVAAPSV
FIFPPSDEQLKSGTASVVCLLNNFYPREAKVQWKVDNALQSGNSQESVTEQDSKDSTYS
LSSTLTLSKADYEKHKVYACEVTHQGLSSPVTKSFNRGEC

Figure 39 (Cont)

Heavy Chain 1 of anti-CD19 x anti-CD32b mAb-Fv (SEQ ID NO: 43)

EVQLVESGGGLVKPGGSLKLSCAASGYTFTSYVMHWVRQAPGKGLEWIGYINPYNDGT
KYNEKFQGRVTISSDKSISTAYMELSSLRSEDTAMYYCARGTYYYGTRVFDYWGQTLV
TVSSASTKGPSVFPLAPSSKSTSGGTAALGCLVKDYFPEPVTVSWNSGALTSGVHTFPA
VLQSSGLYSLSSVVTVPSSSLGTQTYICNVNHKPSNTKVDKKVEPKSCDKTHTCPPCPA
PELLGGPSVFLFPPKPKDTLMISRTPEVTCVVVDVSHEDPEVKFNWYVDGVEVHNAKTK
PREEQYNSTYRVVSVLTVLHQDWLNGKEYKCKVSNKALPAPIEKTISKAKGQPREPQVC
TLPPSREEMTKNQVHLTCLVKGFYPSDIAVEWESNGQPENNYKTTPPVLDSDGSFALYS
KLTVDKSRWQQGNVFSCSVMHEALHNHYTQKSLSLSPGKSSDKTHTSPPSPGGGGSG
GGGSGGGGSGGGGEVQLVESGGGLVSPGGSLKLSCVASGFAFSSYDMSWVRQTPEK
RLEWVAKINSAGGRTNYPDTVKGRFTISRDNAENTLYLQMSSLKSEDTAMYYCAGHSYD
YPFTYWGQGTLVTVSA

Heavy Chain 2 of anti-CD19 x anti-CD32b mAb-Fv (SEQ ID NO: (44)

EVQLVESGGGLVKPGGSLKLSCAASGYTFTSYVMHWVRQAPGKGLEWIGYINPYNDGT
KYNEKFQGRVTISSDKSISTAYMELSSLRSEDTAMYYCARGTYYYGTRVFDYWGQTLV
TVSSASTKGPSVFPLAPSSKSTSGGTAALGCLVKDYFPEPVTVSWNSGALESGVHTFPA
VLQSSGLYSLSSVVTVPSSSLGTQTYICNVNHKPSDTEVDKKVEPKSCDKTHTCPPCPA
PELLGGPSVFLFPPKPKDTLMISRTPEVTCVVVDVSHEDPEVQFNWYVDGVEVHNAKTK
PREEQYNSTYRVVSVLTVLHQDWLNGKEYKCKVSNKALPAPIEKTISKAKGQPREPQVT
TLPPCQEEMTKNQVSLTCLVKGFYPSDIAVEWESSGQPENNYNTFPPMLDSDGSFFLYS
KLTVDKSRWQEGNVFSCSVMHEALHNHYTQKSLSLSPGKSSDKTHTSPPSPGGGGSG
GGGSGGGGSGGGGDVVLTQSPATLSVTPGDSVSLSCRASQGISNNLHWYQQKSHESP
RLLIKYASQSISGIPSRFSGSGSGTDFTLSINSVETEDFGMYFCQQSDSWPHTFGGGTKL
EIK

Light Chain of anti-CD19 x anti-CD32b mAb-Fv (SEQ ID NO: 45)

DIVMTQSPATLSLSPGERATLSCRSSKSLQNVNGNTYLYWFQQKPGQSPQLLIYRMSNL
NSGVPDRFSGSGSGTEFTLTISSLEPEDFAVYYCMQHLEYPITFGAGTKLEIKRTVAAPSV
FIFPPSDEQLKSGTASVVCLLNNFYPREAKVQWKVDNALQSGNSQESVTEQDSKDSTYS
LSSTLTLSKADYEKHKVYACEVTHQGLSSPVTKSFNRGEC

Heavy Chain 1 of anti-CD40 x anti-CD32b mAb-Fv (SEQ ID NO: 46)

QVKLEESGPGLVAPSQSLSITCTVSGFSLSRYSVYWVRQPPGKGLEWLGMMWGGGST
DYNSALKSRLSISKDTSKSQVFLKMNSLQTDDTAMYYCVRTGDYWGQGTSVTVSSAS
TKGPSVFPLAPSSKSTSGGTAALGCLVKDYFPEPVTVSWNSGALTSGVHTFPAVLQSSG
LYSLSSVVTVPSSSLGTQTYICNVNHKPSNTKVDKKVEPKSCDKTHTCPPCPAPELLGGP
SVFLFPPKPKDTLMISRTPEVTCVVVDVSHEDPEVKFNWYVDGVEVHNAKTKPREEQYN
STYRVVSVLTVLHQDWLNGKEYKCKVSNKALPAPIEKTISKAKGQPREPQVCTLPPSREE
MTKNQVHLTCLVKGFYPSDIAVEWESNGQPENNYKTTPPVLDSDGSFALYSKLTVDKSR
WQQGNVFSCSVMHEALHNHYTQKSLSLSPGKSSDKTHTSPPSPGGGGSGGGGSGGG
GSGGGGEVQLVESGGGLVSPGGSLKLSCVASGFAFSSYDMSWVRQTPEKRLEWVAKI
NSAGGRTNYPDTVKGRFTISRDNAENTLYLQMSSLKSEDTAMYYCAGHSYDYPFTYWG
QGTLVTVSA

Fig 39 (Cont)

Heavy Chain 2 of anti-CD40 x anti-CD32b mAb-Fv (SEQ ID NO: 47)

QVKLEESGPGLVAPSQSLSITCTVSGFSLSRYSVYWVRQPPGKGLEWLGMMWGGGST
DYNSALKSRLSISKDTSKSQVFLKMNSLQTDDTAMYYCVRTDGDYWGQGTSVTVSSAS
TKGPSVFPLAPSSKSTSGGTAALGCLVKDYFPEPVTVSWNSGALESGVHTFPAVLQSSG
LYSLSSVVTVPSSSLGTQTYICNVNHKPSDTEVDKKVEPKSCDKTHTCPPCPAPELLGGP
SVFLFPPKPKDTLMISRTPEVTCVVVDVSHEDPEVQFNWYVDGVEVHNAKTKPREEQYN
STYRVVSVLTVLHQDWLNGKEYKCKVSNKALPAPIEKTISKAKGQPREPQVTTLPPCQEE
MTKNQVSLTCLVKGFYPSDIAVEWESSGQPENNYNTFPPMLDSDGSFFLYSKLTVDKSR
WQEGNVFSCSVMHEALHNHYTQKSLSLSPGKSSDKTHTSPPSPGGGGSGGGGSGGG
GSGGGGDVVLTQSPATLSVTPGDSVSLSCRASQGISNNLHWYQQKSHESPRLLIKYASQ
SISGIPSRFSGSGSGTDFTLSINSVETEDFGMYFCQQSDSWPHTFGGGTKLEIK

Light Chain of anti-CD40 x anti-CD32b mAb-Fv (SEQ ID NO: 48)

ELQLTQSPLSLPVSLGDQASISCRSSQSLVNSNGNTYLHWYLQKPGQSPKLLIYKVSNRF
SGVPDRFSGSGSGTDFTLKISRVEAEDLGVYFCSQSTHVPWTFGGGTKLEIKRTVAAPS
VFIFPPSDEQLKSGTASVVCLLNNFYPREAKVQWKVDNALQSGNSQESVTEQDSKDSTY
SLSSTLTLSKADYEKHKVYACEVTHQGLSSPVTKSFNRGEC

Heavy Chain 1 of anti-HER2 x anti-CD3 mAb-Fv (SEQ ID NO: 49)

EVQLVESGGGLVQPGGSLRLSCAASGFNIKDTYIHWVRQAPGKGLEWVARIYPTNGYTR
YADSVKGRFTISADTSKNTAYLQMNSLRAEDTAVYYCSRWGGDGFYAMDYWGQGTLV
TVSSASTKGPSVFPLAPSSKSTSGGTAALGCLVKDYFPEPVTVSWNSGALTSGVHTFPA
VLQSSGLYSLSSVVTVPSSSLGTQTYICNVNHKPSNTKVDKKVEPKSCDKTHTCPPCPA
PELLGGPSVFLFPPKPKDTLMISRTPEVTCVVVDVSHEDPEVKFNWYVDGVEVHNAKTK
PREEQYNSTYRVVSVLTVLHQDWLNGKEYKCKVSNKALPAPIEKTISKAKGQPREPQVC
TLPPSREEMTKNQVHLTCLVKGFYPSDIAVEWESNGQPENNYKTTPPVLDSDGSFALYS
KLTVDKSRWQQGNVFSCSVMHEALHNHYTQKSLSLSPGKSSDKTHTSPPSPGGGGSG
GGGSGGGGSGGGGQVQLVQSGAEVKKPGASVKVSCKASGYTFTRYTMHWVRQAPG
QGLEWMGYINPSRGYTNYNQKFQGRVTMTTDKSTSTAYMELSSLRSEDTAVYYCARYY
DDHYSLDYWGQGTTVTVSS

Heavy Chain 2 of anti-HER2 x anti-CD3 mAb-Fv (SEQ ID NO: 70)

EVQLVESGGGLVQPGGSLRLSCAASGFNIKDTYIHWVRQAPGKGLEWVARIYPTNGYTR
YADSVKGRFTISADTSKNTAYLQMNSLRAEDTAVYYCSRWGGDGFYAMDYWGQGTLV
TVSSASTKGPSVFPLAPSSKSTSGGTAALGCLVKDYFPEPVTVSWNSGALESGVHTFPA
VLQSSGLYSLSSVVTVPSSSLGTQTYICNVNHKPSDTEVDKKVEPKSCDKTHTCPPCPA
PELLGGPSVFLFPPKPKDTLMISRTPEVTCVVVDVSHEDPEVQFNWYVDGVEVHNAKTK
PREEQYNSTYRVVSVLTVLHQDWLNGKEYKCKVSNKALPAPIEKTISKAKGQPREPQVT
TLPPCQEEMTKNQVSLTCLVKGFYPSDIAVEWESSGQPENNYNTFPPMLDSDGSFFLYS
KLTVDKSRWQEGNVFSCSVMHEALHNHYTQKSLSLSPGKSSDKTHTSPPSPGGGGSG
GGGSGGGGQIVLTQSPATLSLSPGERATLSCRASSSVSYMNWYQQKPGQSPR
RLIYDTSKLASGVPARFRGSGSGTDYTLTISSLEPEDFAVYYCQQWSSNPFTFGSGTKLE
IK

Light Chain of anti-HER2 x anti-CD3 mAb-Fv (SEQ ID NO: 71)

DIQMTQSPSSLSASVGDRVTITCRASQDVNTAVAWYQQKPGKAPKLLIYSASFLYSGVPS
RFSGSRSGTDFTLTISSLQPEDFATYYCQQHYTTPPTFGQGTKVEIKRTVAAPSVFIFPPS

Figure 39 (Cont)

DEQLKSGTASVVCLLNNFYPREAKVQWKVDNALQSGNSQESVTEQDSKDSTYSLSSTL
TLSKADYEKHKVYACEVTHQGLSSPVTKSFNRGEC

Heavy Chain 1 of anti-HER2 x anti-CD3 scFv-Fc (SEQ ID NO: 72)

QVQLVQSGAEVKKPGASVKVSCKASGYTFTRYTMHWVRQAPGQGLEWMGYINPSRGY
TNYNQKFQGRVTMTTDKSTSTAYMELSSLRSEDTAVYYCARYYDDHYSLDYWGQGTTV
TVSSGGGGSGGGGSGGGGSQIVLTQSPATLSLSPGERATLSCRASSSVSYMNWYQQK
PGQSPRRLIYDTSKLASGVPARFRGSGSGTDYTLTISSLEPEDFAVYYCQQWSSNPFTF
GSGTKLEIKRTEPKSSDKTHTCPPCPAPELLGGPSVFLFPPKPKDTLMISRTPEVTCVVV
DVSHEDPEVKFNWYVDGVEVHNAKTKPREEQYNSTYRVVSVLTVLHQDWLNGKEYKC
KVSNKALPAPIEKTISKAKGQPREPQVCTLPPSREEMTKNQVHLTCLVKGFYPSDIAVEW
ESNGQPENNYKTTPPVLDSDGSFALYSKLTVDKSRWQQGNVFSCSVMHEALHNHYTQK
SLSLSPGK

Heavy Chain 2 of anti-HER2 x anti-CD3 scFv-Fc (SEQ ID NO: 73)

EVQLVESGGGLVQPGGSLRLSCAASGFNIKDTYIHWVRQAPGKGLEWVARIYPTNGYTR
YADSVKGRFTISADTSKNTAYLQMNSLRAEDTAVYYCSRWGGDGFYAMDYWGQGTLV
TVSSGGGGSGGGGSGGGGSDIQMTQSPSSLSASVGDRVTITCRASQDVNTAVAWYQQ
KPGKAPKLLIYSASFLYSGVPSRFSGSRSGTDFTLTISSLQPEDFATYYCQQHYTTPPTF
GQGTKVEIKRTEPKSSDKTHTCPPCPAPELLGGPSVFLFPPKPKDTLMISRTPEVTCVVV
DVSHEDPEVQFNWYVDGVEVHNAKTKPREEQYNSTYRVVSVLTVLHQDWLNGKEYKC
KVSNKALPAPIEKTISKAKGQPREPQVTLPPCQEEMTKNQVSLTCLVKGFYPSDIAVEW
ESSGQPENNYNTFPPMLDSDGSFFLYSKLTVDKSRWQEGNVFSCSVMHEALHNHYTQK
SLSLSPGK

Figure 40
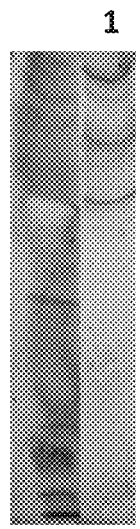
1 – XENP10653 Protein A purified (pre-anion exchange)
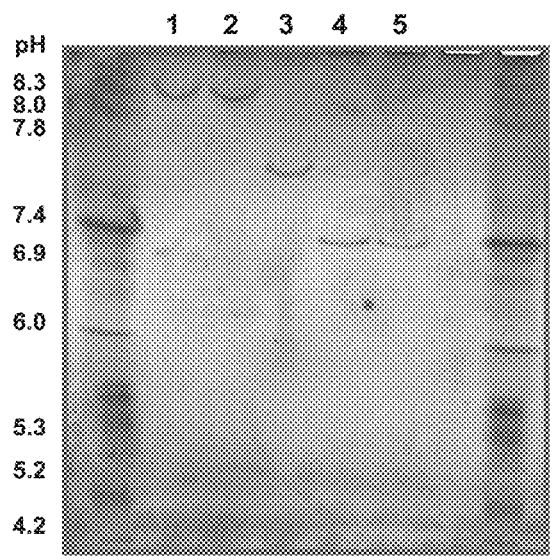
|   | XENP# |
|---|---|
|   | Marker |
| 1 | XENP10653_FT_20111004 |
| 2 | XENP10653_wash_20111004 |
| 3 | XENP10653_Elution1_20111004<br>Elution1 [20mM Tris (7.6), 50mM NaCl] |
| 4 | XENP10653_Elution2_20111004<br>Elution2 [20mM Tris (7.6), 100mM NaCl] |
| 5 | XENP10653_Elution3_20111004<br>Elution3 [20mM Tris (7.6), 200mM NaCl] |
|   | Marker |

Figure 43

SEQ ID NOS: 425 and 442

Chain H = SEQ ID NO: 425
Chain L = SEQ ID NO: 442

| Chain | Position | Amino acid | % exposed | Chain | Position | Amino acid | % exposed |
|-------|----------|------------|-----------|-------|----------|------------|-----------|
| H | 118 | A | 18% | H | 338 | K | 10% |
| H | 119 | S | 60% | H | 339 | A | 44% |
| H | 120 | T | 51% | H | 340 | K | 60% |
| H | 121 | K | 38% | H | 341 | G | 47% |
| H | 122 | G | 25% | H | 342 | Q | 72% |
| H | 123 | P | 9% | H | 343 | P | 48% |
| H | 124 | S | 20% | H | 344 | R | 39% |
| H | 125 | V | 8% | H | 345 | E | 63% |
| H | 126 | F | 14% | H | 346 | P | 4% |
| H | 127 | P | 18% | H | 347 | Q | 24% |
| H | 128 | L | 2% | H | 348 | V | 4% |
| H | 129 | A | 17% | H | 349 | Y | 5% |
| H | 130 | P | 4% | H | 350 | T | 9% |
| H | 131 | S | 79% | H | 351 | L | 2% |
| H | 132 | S | 83% | H | 352 | P | 39% |
| H | 133 | K | 40% | H | 353 | P | 9% |
| H | 134 | S | 77% | H | 354 | S | 10% |
| H | 135 | T | 55% | H | 355 | R | 71% |
| H | 136 | S | 94% | H | 356 | D | 46% |
| H | 137 | G | 91% | H | 357 | E | 1% |
| H | 138 | G | 49% | H | 358 | L | 30% |
| H | 139 | T | 61% | H | 359 | T | 70% |
| H | 140 | A | 12% | H | 360 | K | 39% |
| H | 141 | A | 2% | H | 361 | N | 75% |
| H | 142 | L | 0% | H | 362 | Q | 46% |
| H | 143 | G | 0% | H | 363 | V | 0% |
| H | 144 | C | 0% | H | 364 | S | 2% |
| H | 145 | L | 1% | H | 365 | L | 0% |
| H | 146 | V | 0% | H | 366 | T | 0% |
| H | 147 | K | 3% | H | 367 | C | 0% |
| H | 148 | D | 22% | H | 368 | L | 1% |
| H | 149 | Y | 0% | H | 369 | V | 0% |
| H | 150 | F | 3% | H | 370 | K | 15% |
| H | 151 | P | 6% | H | 371 | G | 15% |
| H | 152 | E | 38% | H | 372 | F | 0% |
| H | 153 | P | 64% | H | 373 | Y | 23% |
| H | 154 | V | 12% | H | 374 | P | 2% |
| H | 155 | T | 54% | H | 375 | S | 29% |
| H | 156 | V | 13% | H | 376 | D | 31% |
| H | 157 | S | 27% | H | 377 | I | 11% |
| H | 158 | W | 0% | H | 378 | A | 12% |
| H | 159 | N | 20% | H | 379 | V | 11% |
| H | 160 | S | 77% | H | 380 | E | 24% |
| H | 161 | G | 54% | H | 381 | W | 0% |

Figure 43 (cont.)

| Chain | Position | Amino acid | % exposed | Chain | Position | Amino acid | % exposed |
|---|---|---|---|---|---|---|---|
| H | 162 | A | 68% | H | 382 | E | 25% |
| H | 163 | L | 18% | H | 383 | S | 5% |
| H | 164 | T | 62% | H | 384 | N | 76% |
| H | 165 | S | 70% | H | 385 | G | 72% |
| H | 166 | G | 38% | H | 386 | Q | 61% |
| H | 167 | V | 19% | H | 387 | P | 60% |
| H | 168 | H | 14% | H | 388 | E | 13% |
| H | 169 | T | 38% | H | 389 | N | 86% |
| H | 170 | F | 1% | H | 390 | N | 35% |
| H | 171 | P | 45% | H | 391 | Y | 25% |
| H | 172 | A | 26% | H | 392 | K | 34% |
| H | 173 | V | 16% | H | 393 | T | 26% |
| H | 174 | L | 51% | H | 394 | T | 2% |
| H | 175 | Q | 11% | H | 395 | P | 47% |
| H | 176 | S | 102% | H | 396 | P | 37% |
| H | 177 | S | 59% | H | 397 | V | 10% |
| H | 178 | G | 19% | H | 398 | L | 48% |
| H | 179 | L | 12% | H | 399 | D | 14% |
| H | 180 | Y | 10% | H | 400 | S | 65% |
| H | 181 | S | 7% | H | 401 | D | 67% |
| H | 182 | L | 6% | H | 402 | G | 37% |
| H | 183 | S | 4% | H | 403 | S | 2% |
| H | 184 | S | 0% | H | 404 | F | 17% |
| H | 185 | V | 0% | H | 405 | F | 0% |
| H | 186 | V | 0% | H | 406 | L | 2% |
| H | 187 | T | 21% | H | 407 | Y | 0% |
| H | 188 | V | 7% | H | 408 | S | 0% |
| H | 189 | P | 52% | H | 409 | K | 1% |
| H | 190 | S | 34% | H | 410 | L | 0% |
| H | 191 | S | 75% | H | 411 | T | 15% |
| H | 192 | S | 15% | H | 412 | V | 3% |
| H | 193 | L | 24% | H | 413 | D | 45% |
| H | 194 | G | 81% | H | 414 | K | 23% |
| H | 195 | T | 72% | H | 415 | S | 48% |
| H | 196 | Q | 52% | H | 416 | R | 30% |
| H | 197 | T | 47% | H | 417 | W | 2% |
| H | 198 | Y | 5% | H | 418 | Q | 42% |
| H | 199 | I | 24% | H | 419 | Q | 67% |
| H | 200 | C | 0% | H | 420 | G | 35% |
| H | 201 | N | 13% | H | 421 | N | 24% |
| H | 202 | V | 1% | H | 422 | V | 43% |
| H | 203 | N | 20% | H | 423 | F | 0% |
| H | 204 | H | 0% | H | 424 | S | 10% |
| H | 205 | K | 72% | H | 425 | C | 0% |
| H | 206 | P | 38% | H | 426 | S | 1% |
| H | 207 | S | 24% | H | 427 | V | 0% |
| H | 208 | N | 82% | H | 428 | M | 2% |
| H | 209 | T | 21% | H | 429 | H | 0% |
| H | 210 | K | 67% | H | 430 | E | 20% |
| H | 211 | V | 29% | H | 431 | A | 22% |

Figure 43 (cont.)

| Chain | Position | Amino acid | % exposed | Chain | Position | Amino acid | % exposed |
|---|---|---|---|---|---|---|---|
| H | 212 | D | 53% | H | 432 | L | 7% |
| H | 213 | K | 26% | H | 433 | H | 80% |
| H | 214 | K | 45% | H | 434 | N | 69% |
| H | 215 | A | 2% | H | 435 | H | 38% |
| H | 216 | E | 59% | H | 436 | Y | 40% |
| H | 217 | P | 34% | H | 437 | T | 23% |
| H | 218 | K | 37% | H | 438 | Q | 42% |
| H | 219 | S | 76% | H | 439 | K | 27% |
| H | 220 | C | 43% | H | 440 | S | 53% |
| H | 221 | D | 45% | H | 441 | L | 7% |
| H | 222 | K | 83% | H | 442 | S | 35% |
| H | 223 | T | 62% | H | 443 | L | 32% |
| H | 224 | H | 64% | H | 444 | S | 78% |
| H | 225 | T | 41% | H | 445 | P | 91% |
| H | 226 | C | 54% | H | 446 | G | 97% |
| H | 227 | P | 78% | H | 447 | K | 86% |
| H | 228 | P | 79% | L | 108 | R | 15% |
| H | 229 | C | 80% | L | 109 | T | 51% |
| H | 230 | P | 79% | L | 110 | V | 43% |
| H | 231 | A | 46% | L | 111 | A | 9% |
| H | 232 | P | 74% | L | 112 | A | 30% |
| H | 233 | E | 65% | L | 113 | P | 7% |
| H | 234 | L | 52% | L | 114 | S | 40% |
| H | 235 | L | 40% | L | 115 | V | 3% |
| H | 236 | G | 63% | L | 116 | F | 13% |
| H | 237 | G | 19% | L | 117 | I | 12% |
| H | 238 | P | 4% | L | 118 | F | 2% |
| H | 239 | S | 30% | L | 119 | P | 24% |
| H | 240 | V | 3% | L | 120 | P | 6% |
| H | 241 | F | 48% | L | 121 | S | 8% |
| H | 242 | L | 12% | L | 122 | D | 62% |
| H | 243 | F | 46% | L | 123 | E | 39% |
| H | 244 | P | 43% | L | 124 | Q | 1% |
| H | 245 | P | 5% | L | 125 | L | 18% |
| H | 246 | K | 56% | L | 126 | K | 74% |
| H | 247 | P | 27% | L | 127 | S | 66% |
| H | 248 | K | 18% | L | 128 | G | 31% |
| H | 249 | D | 13% | L | 129 | T | 36% |
| H | 250 | T | 5% | L | 130 | A | 1% |
| H | 251 | L | 14% | L | 131 | S | 2% |
| H | 252 | M | 21% | L | 132 | V | 2% |
| H | 253 | I | 90% | L | 133 | V | 0% |
| H | 254 | S | 73% | L | 134 | C | 0% |
| H | 255 | R | 37% | L | 135 | L | 0% |
| H | 256 | T | 54% | L | 136 | L | 0% |
| H | 257 | P | 0% | L | 137 | N | 7% |
| H | 258 | E | 39% | L | 138 | N | 26% |
| H | 259 | V | 0% | L | 139 | F | 0% |
| H | 260 | T | 19% | L | 140 | Y | 2% |
| H | 261 | C | 0% | L | 141 | P | 15% |

Figure 43 (cont.)

| Chain | Position | Amino acid | % exposed | Chain | Position | Amino acid | % exposed |
|---|---|---|---|---|---|---|---|
| H | 262 | V | 6% | L | 142 | R | 33% |
| H | 263 | V | 0% | L | 143 | E | 62% |
| H | 264 | V | 22% | L | 144 | A | 18% |
| H | 265 | D | 36% | L | 145 | K | 55% |
| H | 266 | V | 0% | L | 146 | V | 14% |
| H | 267 | S | 13% | L | 147 | Q | 32% |
| H | 268 | H | 37% | L | 148 | W | 2% |
| H | 269 | E | 39% | L | 149 | K | 24% |
| H | 270 | D | 12% | L | 150 | V | 6% |
| H | 271 | P | 22% | L | 151 | D | 32% |
| H | 272 | E | 69% | L | 152 | N | 81% |
| H | 273 | V | 16% | L | 153 | A | 39% |
| H | 274 | K | 60% | L | 154 | L | 62% |
| H | 275 | F | 13% | L | 155 | Q | 17% |
| H | 276 | N | 15% | L | 156 | S | 70% |
| H | 277 | W | 2% | L | 157 | G | 99% |
| H | 278 | Y | 21% | L | 158 | N | 22% |
| H | 279 | V | 15% | L | 159 | S | 33% |
| H | 280 | D | 52% | L | 160 | Q | 34% |
| H | 281 | G | 56% | L | 161 | E | 44% |
| H | 282 | V | 65% | L | 162 | S | 12% |
| H | 283 | E | 38% | L | 163 | V | 19% |
| H | 284 | V | 23% | L | 164 | T | 13% |
| H | 285 | H | 76% | L | 165 | E | 62% |
| H | 286 | N | 57% | L | 166 | Q | 19% |
| H | 287 | A | 27% | L | 167 | D | 26% |
| H | 288 | K | 60% | L | 168 | S | 88% |
| H | 289 | T | 45% | L | 169 | K | 76% |
| H | 290 | K | 40% | L | 170 | D | 28% |
| H | 291 | P | 76% | L | 171 | S | 6% |
| H | 292 | R | 46% | L | 172 | T | 2% |
| H | 293 | E | 51% | L | 173 | Y | 0% |
| H | 294 | E | 55% | L | 174 | S | 0% |
| H | 295 | Q | 31% | L | 175 | L | 1% |
| H | 296 | Y | 101% | L | 176 | S | 2% |
| H | 297 | N | 58% | L | 177 | S | 1% |
| H | 298 | S | 40% | L | 178 | T | 11% |
| H | 299 | T | 16% | L | 179 | L | 1% |
| H | 300 | Y | 14% | L | 180 | T | 29% |
| H | 301 | R | 38% | L | 181 | L | 23% |
| H | 302 | V | 4% | L | 182 | S | 32% |
| H | 303 | V | 8% | L | 183 | K | 35% |
| H | 304 | S | 0% | L | 184 | A | 52% |
| H | 305 | V | 9% | L | 185 | D | 35% |
| H | 306 | L | 2% | L | 186 | Y | 6% |
| H | 307 | T | 40% | L | 187 | E | 48% |
| H | 308 | V | 5% | L | 188 | K | 63% |
| H | 309 | L | 55% | L | 189 | H | 26% |
| H | 310 | H | 24% | L | 190 | K | 64% |
| H | 311 | Q | 62% | L | 191 | V | 33% |

Figure 43 (cont.)

| Chain | Position | Amino acid | % exposed | Chain | Position | Amino acid | % exposed |
|---|---|---|---|---|---|---|---|
| H | 312 | D | 19% | L | 192 | Y | 2% |
| H | 313 | W | 4% | L | 193 | A | 8% |
| H | 314 | L | 25% | L | 194 | C | 0% |
| H | 315 | N | 72% | L | 195 | E | 18% |
| H | 316 | G | 28% | L | 196 | V | 0% |
| H | 317 | K | 33% | L | 197 | T | 32% |
| H | 318 | E | 44% | L | 198 | H | 6% |
| H | 319 | Y | 2% | L | 199 | Q | 60% |
| H | 320 | K | 27% | L | 200 | G | 35% |
| H | 321 | C | 0% | L | 201 | L | 14% |
| H | 322 | K | 25% | L | 202 | R | 80% |
| H | 323 | V | 0% | L | 203 | S | 49% |
| H | 324 | S | 30% | L | 204 | P | 45% |
| H | 325 | N | 8% | L | 205 | V | 21% |
| H | 326 | K | 61% | L | 206 | T | 42% |
| H | 327 | A | 16% | L | 207 | K | 37% |
| H | 328 | L | 9% | L | 208 | S | 45% |
| H | 329 | P | 46% | L | 209 | F | 14% |
| H | 330 | A | 40% | L | 210 | N | 47% |
| H | 331 | P | 43% | L | 211 | R | 35% |
| H | 332 | I | 34% | L | 212 | G | 61% |
| H | 333 | E | 51% | L | 213 | E | 69% |
| H | 334 | K | 35% | L | 214 | C | 68% |
| H | 335 | T | 47% | | | | |
| H | 336 | I | 19% | | | | |
| H | 337 | S | 28% | | | | |

SEQ ID NOS: 425 and 442

Chain H = SEQ ID NO: 425
Chain L = SEQ ID NO: 442

Figure 44

| Neutral or Basic to Acidic | | | | |
|---|---|---|---|---|
| Variant | IgG1 / IgG1 | pI / IgG1 | pI / pI | delta pI |
| HC S119D | 8.02 | 7.94 | 7.85 | -0.09 |
| HC S119E | 8.02 | 7.94 | 7.85 | -0.09 |
| HC T120D | 8.02 | 7.94 | 7.85 | -0.09 |
| HC T120E | 8.02 | 7.94 | 7.85 | -0.09 |
| HC K121D | 8.02 | 7.85 | 7.61 | -0.21 |
| HC K121E | 8.02 | 7.85 | 7.61 | -0.21 |
| HC G122D | 8.02 | 7.94 | 7.85 | -0.09 |
| HC G122E | 8.02 | 7.94 | 7.85 | -0.09 |
| HC S131D | 8.02 | 7.94 | 7.85 | -0.09 |
| HC S131E | 8.02 | 7.94 | 7.85 | -0.09 |
| HC S132D | 8.02 | 7.94 | 7.85 | -0.09 |
| HC S132E | 8.02 | 7.94 | 7.85 | -0.09 |
| HC K133D | 8.02 | 7.85 | 7.61 | -0.21 |
| HC K133E | 8.02 | 7.85 | 7.61 | -0.21 |
| HC S134D | 8.02 | 7.94 | 7.85 | -0.09 |
| HC S134E | 8.02 | 7.94 | 7.85 | -0.09 |
| HC T135D | 8.02 | 7.94 | 7.85 | -0.09 |
| HC T135E | 8.02 | 7.94 | 7.85 | -0.09 |
| HC S136D | 8.02 | 7.94 | 7.85 | -0.09 |
| HC S136E | 8.02 | 7.94 | 7.85 | -0.09 |
| HC G137D | 8.02 | 7.94 | 7.85 | -0.09 |
| HC G137E | 8.02 | 7.94 | 7.85 | -0.09 |
| HC G138D | 8.02 | 7.94 | 7.85 | -0.09 |
| HC G138E | 8.02 | 7.94 | 7.85 | -0.09 |
| HC T139D | 8.02 | 7.94 | 7.85 | -0.09 |
| HC T139E | 8.02 | 7.94 | 7.85 | -0.09 |
| HC P153D | 8.02 | 7.94 | 7.85 | -0.09 |
| HC P153E | 8.02 | 7.94 | 7.85 | -0.09 |
| HC T155D | 8.02 | 7.94 | 7.85 | -0.09 |
| HC T155E | 8.02 | 7.94 | 7.85 | -0.09 |
| HC S157D | 8.02 | 7.94 | 7.85 | -0.09 |
| HC S157E | 8.02 | 7.94 | 7.85 | -0.09 |
| HC N159D | 8.02 | 7.94 | 7.85 | -0.09 |
| HC N159E | 8.02 | 7.94 | 7.85 | -0.09 |
| HC S160D | 8.02 | 7.94 | 7.85 | -0.09 |
| HC S160E | 8.02 | 7.94 | 7.85 | -0.09 |
| HC G161D | 8.02 | 7.94 | 7.85 | -0.09 |
| HC G161E | 8.02 | 7.94 | 7.85 | -0.09 |
| HC A162D | 8.02 | 7.94 | 7.85 | -0.09 |
| HC A162E | 8.02 | 7.94 | 7.85 | -0.09 |
| HC T164D | 8.02 | 7.94 | 7.85 | -0.09 |
| HC T164E | 8.02 | 7.94 | 7.85 | -0.09 |
| HC S165D | 8.02 | 7.94 | 7.85 | -0.09 |
| HC S165E | 8.02 | 7.94 | 7.85 | -0.09 |
| HC G166D | 8.02 | 7.94 | 7.85 | -0.09 |
| HC G166E | 8.02 | 7.94 | 7.85 | -0.09 |
| HC T169D | 8.02 | 7.94 | 7.85 | -0.09 |
| HC T169E | 8.02 | 7.94 | 7.85 | -0.09 |
| HC P171D | 8.02 | 7.94 | 7.85 | -0.09 |

Figure 44 (cont.)

| Variant | Neutral or Basic to Acidic IgG1 / IgG1 | pI / IgG1 | pI / pI | delta pI |
|---|---|---|---|---|
| HC P171E | 8.02 | 7.94 | 7.85 | -0.09 |
| HC A172D | 8.02 | 7.94 | 7.85 | -0.09 |
| HC A172E | 8.02 | 7.94 | 7.85 | -0.09 |
| HC L174D | 8.02 | 7.94 | 7.85 | -0.09 |
| HC L174E | 8.02 | 7.94 | 7.85 | -0.09 |
| HC S176D | 8.02 | 7.94 | 7.85 | -0.09 |
| HC S176E | 8.02 | 7.94 | 7.85 | -0.09 |
| HC S177D | 8.02 | 7.94 | 7.85 | -0.09 |
| HC S177E | 8.02 | 7.94 | 7.85 | -0.09 |
| HC T187D | 8.02 | 7.94 | 7.85 | -0.09 |
| HC T187E | 8.02 | 7.94 | 7.85 | -0.09 |
| HC P189D | 8.02 | 7.94 | 7.85 | -0.09 |
| HC P189E | 8.02 | 7.94 | 7.85 | -0.09 |
| HC S190D | 8.02 | 7.94 | 7.85 | -0.09 |
| HC S190E | 8.02 | 7.94 | 7.85 | -0.09 |
| HC S191D | 8.02 | 7.94 | 7.85 | -0.09 |
| HC S191E | 8.02 | 7.94 | 7.85 | -0.09 |
| HC L193D | 8.02 | 7.94 | 7.85 | -0.09 |
| HC L193E | 8.02 | 7.94 | 7.85 | -0.09 |
| HC G194D | 8.02 | 7.94 | 7.85 | -0.09 |
| HC G194E | 8.02 | 7.94 | 7.85 | -0.09 |
| HC T195D | 8.02 | 7.94 | 7.85 | -0.09 |
| HC T195E | 8.02 | 7.94 | 7.85 | -0.09 |
| HC Q196D | 8.02 | 7.94 | 7.85 | -0.09 |
| HC Q196E | 8.02 | 7.94 | 7.85 | -0.09 |
| HC T197D | 8.02 | 7.94 | 7.85 | -0.09 |
| HC T197E | 8.02 | 7.94 | 7.85 | -0.09 |
| HC I199D | 8.02 | 7.94 | 7.85 | -0.09 |
| HC I199E | 8.02 | 7.94 | 7.85 | -0.09 |
| HC N203D | 8.02 | 7.94 | 7.85 | -0.09 |
| HC N203E | 8.02 | 7.94 | 7.85 | -0.09 |
| HC K205D | 8.02 | 7.85 | 7.61 | -0.21 |
| HC K205E | 8.02 | 7.85 | 7.61 | -0.21 |
| HC P206D | 8.02 | 7.94 | 7.85 | -0.09 |
| HC P206E | 8.02 | 7.94 | 7.85 | -0.09 |
| HC S207D | 8.02 | 7.94 | 7.85 | -0.09 |
| HC S207E | 8.02 | 7.94 | 7.85 | -0.09 |
| HC N208D | 8.02 | 7.94 | 7.85 | -0.09 |
| HC N208E | 8.02 | 7.94 | 7.85 | -0.09 |
| HC T209D | 8.02 | 7.94 | 7.85 | -0.09 |
| HC T209E | 8.02 | 7.94 | 7.85 | -0.09 |
| HC K210D | 8.02 | 7.85 | 7.61 | -0.21 |
| HC K210E | 8.02 | 7.85 | 7.61 | -0.21 |
| HC V211D | 8.02 | 7.94 | 7.85 | -0.09 |
| HC V211E | 8.02 | 7.94 | 7.85 | -0.09 |
| HC K213D | 8.02 | 7.85 | 7.61 | -0.21 |
| HC K213E | 8.02 | 7.85 | 7.61 | -0.21 |
| HC K214D | 8.02 | 7.85 | 7.61 | -0.21 |
| HC K214E | 8.02 | 7.85 | 7.61 | -0.21 |
| HC P217D | 8.02 | 7.94 | 7.85 | -0.09 |
| HC P217E | 8.02 | 7.94 | 7.85 | -0.09 |

Figure 44 (cont.)

| Variant | Neutral or Basic to Acidic | | | |
|---|---|---|---|---|
| | IgG1 / IgG1 | pI / IgG1 | pI / pI | delta pI |
| HC K218D | 8.02 | 7.85 | 7.61 | -0.21 |
| HC K218E | 8.02 | 7.85 | 7.61 | -0.21 |
| HC S219D | 8.02 | 7.94 | 7.85 | -0.09 |
| HC S219E | 8.02 | 7.94 | 7.85 | -0.09 |
| HC C220D | 8.02 | 7.95 | 7.86 | -0.08 |
| HC C220E | 8.02 | 7.95 | 7.86 | -0.08 |
| HC K222D | 8.02 | 7.85 | 7.61 | -0.21 |
| HC K222E | 8.02 | 7.85 | 7.61 | -0.21 |
| HC T223D | 8.02 | 7.94 | 7.85 | -0.09 |
| HC T223E | 8.02 | 7.94 | 7.85 | -0.09 |
| HC H224D | 8.02 | 7.94 | 7.84 | -0.09 |
| HC H224E | 8.02 | 7.94 | 7.84 | -0.09 |
| HC T225D | 8.02 | 7.94 | 7.85 | -0.09 |
| HC T225E | 8.02 | 7.94 | 7.85 | -0.09 |
| HC C226D | 8.02 | 7.95 | 7.86 | -0.08 |
| HC C226E | 8.02 | 7.95 | 7.86 | -0.08 |
| HC P227D | 8.02 | 7.94 | 7.85 | -0.09 |
| HC P227E | 8.02 | 7.94 | 7.85 | -0.09 |
| HC P228D | 8.02 | 7.94 | 7.85 | -0.09 |
| HC P228E | 8.02 | 7.94 | 7.85 | -0.09 |
| HC C229D | 8.02 | 7.95 | 7.86 | -0.08 |
| HC C229E | 8.02 | 7.95 | 7.86 | -0.08 |
| HC P230D | 8.02 | 7.94 | 7.85 | -0.09 |
| HC P230E | 8.02 | 7.94 | 7.85 | -0.09 |
| HC A231D | 8.02 | 7.94 | 7.85 | -0.09 |
| HC A231E | 8.02 | 7.94 | 7.85 | -0.09 |
| HC P232D | 8.02 | 7.94 | 7.85 | -0.09 |
| HC P232E | 8.02 | 7.94 | 7.85 | -0.09 |
| HC L234D | 8.02 | 7.94 | 7.85 | -0.09 |
| HC L234E | 8.02 | 7.94 | 7.85 | -0.09 |
| HC L235D | 8.02 | 7.94 | 7.85 | -0.09 |
| HC L235E | 8.02 | 7.94 | 7.85 | -0.09 |
| HC G236D | 8.02 | 7.94 | 7.85 | -0.09 |
| HC G236E | 8.02 | 7.94 | 7.85 | -0.09 |
| HC S239D | 8.02 | 7.94 | 7.85 | -0.09 |
| HC S239E | 8.02 | 7.94 | 7.85 | -0.09 |
| HC F241D | 8.02 | 7.94 | 7.85 | -0.09 |
| HC F241E | 8.02 | 7.94 | 7.85 | -0.09 |
| HC F243D | 8.02 | 7.94 | 7.85 | -0.09 |
| HC F243E | 8.02 | 7.94 | 7.85 | -0.09 |
| HC P244D | 8.02 | 7.94 | 7.85 | -0.09 |
| HC P244E | 8.02 | 7.94 | 7.85 | -0.09 |
| HC K246D | 8.02 | 7.85 | 7.61 | -0.21 |
| HC K246E | 8.02 | 7.85 | 7.61 | -0.21 |
| HC P247D | 8.02 | 7.94 | 7.85 | -0.09 |
| HC P247E | 8.02 | 7.94 | 7.85 | -0.09 |
| HC M252D | 8.02 | 7.94 | 7.85 | -0.09 |
| HC M252E | 8.02 | 7.94 | 7.85 | -0.09 |
| HC I253D | 8.02 | 7.94 | 7.85 | -0.09 |
| HC I253E | 8.02 | 7.94 | 7.85 | -0.09 |
| HC S254D | 8.02 | 7.94 | 7.85 | -0.09 |

Figure 44 (cont.)

| Variant | Neutral or Basic to Acidic | | | |
| --- | --- | --- | --- | --- |
| | IgG1 / IgG1 | pI / IgG1 | pI / pI | delta pI |
| HC S254E | 8.02 | 7.94 | 7.85 | -0.09 |
| HC R255D | 8.02 | 7.85 | 7.61 | -0.21 |
| HC R255E | 8.02 | 7.85 | 7.61 | -0.21 |
| HC T256D | 8.02 | 7.94 | 7.85 | -0.09 |
| HC T256E | 8.02 | 7.94 | 7.85 | -0.09 |
| HC V264D | 8.02 | 7.94 | 7.85 | -0.09 |
| HC V264E | 8.02 | 7.94 | 7.85 | -0.09 |
| HC H268D | 8.02 | 7.94 | 7.84 | -0.09 |
| HC H268E | 8.02 | 7.94 | 7.84 | -0.09 |
| HC P271D | 8.02 | 7.94 | 7.85 | -0.09 |
| HC P271E | 8.02 | 7.94 | 7.85 | -0.09 |
| HC K274D | 8.02 | 7.85 | 7.61 | -0.21 |
| HC K274E | 8.02 | 7.85 | 7.61 | -0.21 |
| HC Y278D | 8.02 | 7.94 | 7.85 | -0.09 |
| HC Y278E | 8.02 | 7.94 | 7.85 | -0.09 |
| HC G281D | 8.02 | 7.94 | 7.85 | -0.09 |
| HC G281E | 8.02 | 7.94 | 7.85 | -0.09 |
| HC V282D | 8.02 | 7.94 | 7.85 | -0.09 |
| HC V282E | 8.02 | 7.94 | 7.85 | -0.09 |
| HC V284D | 8.02 | 7.94 | 7.85 | -0.09 |
| HC V284E | 8.02 | 7.94 | 7.85 | -0.09 |
| HC H285D | 8.02 | 7.94 | 7.84 | -0.09 |
| HC H285E | 8.02 | 7.94 | 7.84 | -0.09 |
| HC N286D | 8.02 | 7.94 | 7.85 | -0.09 |
| HC N286E | 8.02 | 7.94 | 7.85 | -0.09 |
| HC A287D | 8.02 | 7.94 | 7.85 | -0.09 |
| HC A287E | 8.02 | 7.94 | 7.85 | -0.09 |
| HC K288D | 8.02 | 7.85 | 7.61 | -0.21 |
| HC K288E | 8.02 | 7.85 | 7.61 | -0.21 |
| HC T289D | 8.02 | 7.94 | 7.85 | -0.09 |
| HC T289E | 8.02 | 7.94 | 7.85 | -0.09 |
| HC K290D | 8.02 | 7.85 | 7.61 | -0.21 |
| HC K290E | 8.02 | 7.85 | 7.61 | -0.21 |
| HC P291D | 8.02 | 7.94 | 7.85 | -0.09 |
| HC P291E | 8.02 | 7.94 | 7.85 | -0.09 |
| HC R292D | 8.02 | 7.85 | 7.61 | -0.21 |
| HC R292E | 8.02 | 7.85 | 7.61 | -0.21 |
| HC Q295D | 8.02 | 7.94 | 7.85 | -0.09 |
| HC Q295E | 8.02 | 7.94 | 7.85 | -0.09 |
| HC Y296D | 8.02 | 7.94 | 7.85 | -0.09 |
| HC Y296E | 8.02 | 7.94 | 7.85 | -0.09 |
| HC N297D | 8.02 | 7.94 | 7.85 | -0.09 |
| HC N297E | 8.02 | 7.94 | 7.85 | -0.09 |
| HC S298D | 8.02 | 7.94 | 7.85 | -0.09 |
| HC S298E | 8.02 | 7.94 | 7.85 | -0.09 |
| HC R301D | 8.02 | 7.85 | 7.61 | -0.21 |
| HC R301E | 8.02 | 7.85 | 7.61 | -0.21 |
| HC T307D | 8.02 | 7.94 | 7.85 | -0.09 |
| HC T307E | 8.02 | 7.94 | 7.85 | -0.09 |
| HC L309D | 8.02 | 7.94 | 7.85 | -0.09 |
| HC L309E | 8.02 | 7.94 | 7.85 | -0.09 |

Figure 44 (cont.)

| Variant | Neutral or Basic to Acidic | | | |
|---|---|---|---|---|
| | IgG1 / IgG1 | pI / IgG1 | pI / pI | delta pI |
| HC H310D | 8.02 | 7.94 | 7.84 | -0.09 |
| HC H310E | 8.02 | 7.94 | 7.84 | -0.09 |
| HC Q311D | 8.02 | 7.94 | 7.85 | -0.09 |
| HC Q311E | 8.02 | 7.94 | 7.85 | -0.09 |
| HC L314D | 8.02 | 7.94 | 7.85 | -0.09 |
| HC L314E | 8.02 | 7.94 | 7.85 | -0.09 |
| HC N315D | 8.02 | 7.94 | 7.85 | -0.09 |
| HC N315E | 8.02 | 7.94 | 7.85 | -0.09 |
| HC G316D | 8.02 | 7.94 | 7.85 | -0.09 |
| HC G316E | 8.02 | 7.94 | 7.85 | -0.09 |
| HC K317D | 8.02 | 7.85 | 7.61 | -0.21 |
| HC K317E | 8.02 | 7.85 | 7.61 | -0.21 |
| HC K320D | 8.02 | 7.85 | 7.61 | -0.21 |
| HC K320E | 8.02 | 7.85 | 7.61 | -0.21 |
| HC K322D | 8.02 | 7.85 | 7.61 | -0.21 |
| HC K322E | 8.02 | 7.85 | 7.61 | -0.21 |
| HC S324D | 8.02 | 7.94 | 7.85 | -0.09 |
| HC S324E | 8.02 | 7.94 | 7.85 | -0.09 |
| HC K326D | 8.02 | 7.85 | 7.61 | -0.21 |
| HC K326E | 8.02 | 7.85 | 7.61 | -0.21 |
| HC P329D | 8.02 | 7.94 | 7.85 | -0.09 |
| HC P329E | 8.02 | 7.94 | 7.85 | -0.09 |
| HC A330D | 8.02 | 7.94 | 7.85 | -0.09 |
| HC A330E | 8.02 | 7.94 | 7.85 | -0.09 |
| HC P331D | 8.02 | 7.94 | 7.85 | -0.09 |
| HC P331E | 8.02 | 7.94 | 7.85 | -0.09 |
| HC I332D | 8.02 | 7.94 | 7.85 | -0.09 |
| HC I332E | 8.02 | 7.94 | 7.85 | -0.09 |
| HC K334D | 8.02 | 7.85 | 7.61 | -0.21 |
| HC K334E | 8.02 | 7.85 | 7.61 | -0.21 |
| HC T335D | 8.02 | 7.94 | 7.85 | -0.09 |
| HC T335E | 8.02 | 7.94 | 7.85 | -0.09 |
| HC S337D | 8.02 | 7.94 | 7.85 | -0.09 |
| HC S337E | 8.02 | 7.94 | 7.85 | -0.09 |
| HC A339D | 8.02 | 7.94 | 7.85 | -0.09 |
| HC A339E | 8.02 | 7.94 | 7.85 | -0.09 |
| HC K340D | 8.02 | 7.85 | 7.61 | -0.21 |
| HC K340E | 8.02 | 7.85 | 7.61 | -0.21 |
| HC G341D | 8.02 | 7.94 | 7.85 | -0.09 |
| HC G341E | 8.02 | 7.94 | 7.85 | -0.09 |
| HC Q342D | 8.02 | 7.94 | 7.85 | -0.09 |
| HC Q342E | 8.02 | 7.94 | 7.85 | -0.09 |
| HC P343D | 8.02 | 7.94 | 7.85 | -0.09 |
| HC P343E | 8.02 | 7.94 | 7.85 | -0.09 |
| HC R344D | 8.02 | 7.85 | 7.61 | -0.21 |
| HC R344E | 8.02 | 7.85 | 7.61 | -0.21 |
| HC Q347D | 8.02 | 7.94 | 7.85 | -0.09 |
| HC Q347E | 8.02 | 7.94 | 7.85 | -0.09 |
| HC P352D | 8.02 | 7.94 | 7.85 | -0.09 |
| HC P352E | 8.02 | 7.94 | 7.85 | -0.09 |
| HC R355D | 8.02 | 7.85 | 7.61 | -0.21 |

Figure 44 (cont.)

| Variant | Neutral or Basic to Acidic | | | |
|---|---|---|---|---|
| | IgG1 / IgG1 | pI / IgG1 | pI / pI | delta pI |
| HC R355E | 8.02 | 7.85 | 7.61 | -0.21 |
| HC M358D | 8.02 | 7.94 | 7.85 | -0.09 |
| HC M358E | 8.02 | 7.94 | 7.85 | -0.09 |
| HC T359D | 8.02 | 7.94 | 7.85 | -0.09 |
| HC T359E | 8.02 | 7.94 | 7.85 | -0.09 |
| HC K360D | 8.02 | 7.85 | 7.61 | -0.21 |
| HC K360E | 8.02 | 7.85 | 7.61 | -0.21 |
| HC N361D | 8.02 | 7.94 | 7.85 | -0.09 |
| HC N361E | 8.02 | 7.94 | 7.85 | -0.09 |
| HC Q362D | 8.02 | 7.94 | 7.85 | -0.09 |
| HC Q362E | 8.02 | 7.94 | 7.85 | -0.09 |
| HC Y373D | 8.02 | 7.94 | 7.85 | -0.09 |
| HC Y373E | 8.02 | 7.94 | 7.85 | -0.09 |
| HC S375D | 8.02 | 7.94 | 7.85 | -0.09 |
| HC S375E | 8.02 | 7.94 | 7.85 | -0.09 |
| HC N384D | 8.02 | 7.94 | 7.85 | -0.09 |
| HC N384E | 8.02 | 7.94 | 7.85 | -0.09 |
| HC G385D | 8.02 | 7.94 | 7.85 | -0.09 |
| HC G385E | 8.02 | 7.94 | 7.85 | -0.09 |
| HC Q386D | 8.02 | 7.94 | 7.85 | -0.09 |
| HC Q386E | 8.02 | 7.94 | 7.85 | -0.09 |
| HC P387D | 8.02 | 7.94 | 7.85 | -0.09 |
| HC P387E | 8.02 | 7.94 | 7.85 | -0.09 |
| HC N389D | 8.02 | 7.94 | 7.85 | -0.09 |
| HC N389E | 8.02 | 7.94 | 7.85 | -0.09 |
| HC N390D | 8.02 | 7.94 | 7.85 | -0.09 |
| HC N390E | 8.02 | 7.94 | 7.85 | -0.09 |
| HC Y391D | 8.02 | 7.94 | 7.85 | -0.09 |
| HC Y391E | 8.02 | 7.94 | 7.85 | -0.09 |
| HC K392D | 8.02 | 7.85 | 7.61 | -0.21 |
| HC K392E | 8.02 | 7.85 | 7.61 | -0.21 |
| HC T393D | 8.02 | 7.94 | 7.85 | -0.09 |
| HC T393E | 8.02 | 7.94 | 7.85 | -0.09 |
| HC P395D | 8.02 | 7.94 | 7.85 | -0.09 |
| HC P395E | 8.02 | 7.94 | 7.85 | -0.09 |
| HC P396D | 8.02 | 7.94 | 7.85 | -0.09 |
| HC P396E | 8.02 | 7.94 | 7.85 | -0.09 |
| HC L398D | 8.02 | 7.94 | 7.85 | -0.09 |
| HC L398E | 8.02 | 7.94 | 7.85 | -0.09 |
| HC S400D | 8.02 | 7.94 | 7.85 | -0.09 |
| HC S400E | 8.02 | 7.94 | 7.85 | -0.09 |
| HC G402D | 8.02 | 7.94 | 7.85 | -0.09 |
| HC G402E | 8.02 | 7.94 | 7.85 | -0.09 |
| HC K414D | 8.02 | 7.85 | 7.61 | -0.21 |
| HC K414E | 8.02 | 7.85 | 7.61 | -0.21 |
| HC S415D | 8.02 | 7.94 | 7.85 | -0.09 |
| HC S415E | 8.02 | 7.94 | 7.85 | -0.09 |
| HC R416D | 8.02 | 7.85 | 7.61 | -0.21 |
| HC R416E | 8.02 | 7.85 | 7.61 | -0.21 |
| HC Q418D | 8.02 | 7.94 | 7.85 | -0.09 |
| HC Q418E | 8.02 | 7.94 | 7.85 | -0.09 |

Figure 44 (cont.)

| Variant | Neutral or Basic to Acidic | | | |
| --- | --- | --- | --- | --- |
| | IgG1 / IgG1 | pI / IgG1 | pI / pI | delta pI |
| HC Q419D | 8.02 | 7.94 | 7.85 | -0.09 |
| HC Q419E | 8.02 | 7.94 | 7.85 | -0.09 |
| HC G420D | 8.02 | 7.94 | 7.85 | -0.09 |
| HC G420E | 8.02 | 7.94 | 7.85 | -0.09 |
| HC N421D | 8.02 | 7.94 | 7.85 | -0.09 |
| HC N421E | 8.02 | 7.94 | 7.85 | -0.09 |
| HC V422D | 8.02 | 7.94 | 7.85 | -0.09 |
| HC V422E | 8.02 | 7.94 | 7.85 | -0.09 |
| HC A431D | 8.02 | 7.94 | 7.85 | -0.09 |
| HC A431E | 8.02 | 7.94 | 7.85 | -0.09 |
| HC H433D | 8.02 | 7.94 | 7.84 | -0.09 |
| HC H433E | 8.02 | 7.94 | 7.84 | -0.09 |
| HC N434D | 8.02 | 7.94 | 7.85 | -0.09 |
| HC N434E | 8.02 | 7.94 | 7.85 | -0.09 |
| HC H435D | 8.02 | 7.94 | 7.84 | -0.09 |
| HC H435E | 8.02 | 7.94 | 7.84 | -0.09 |
| HC Y436D | 8.02 | 7.94 | 7.85 | -0.09 |
| HC Y436E | 8.02 | 7.94 | 7.85 | -0.09 |
| HC T437D | 8.02 | 7.94 | 7.85 | -0.09 |
| HC T437E | 8.02 | 7.94 | 7.85 | -0.09 |
| HC Q438D | 8.02 | 7.94 | 7.85 | -0.09 |
| HC Q438E | 8.02 | 7.94 | 7.85 | -0.09 |
| HC K439D | 8.02 | 7.85 | 7.61 | -0.21 |
| HC K439E | 8.02 | 7.85 | 7.61 | -0.21 |
| HC S440D | 8.02 | 7.94 | 7.85 | -0.09 |
| HC S440E | 8.02 | 7.94 | 7.85 | -0.09 |
| HC S442D | 8.02 | 7.94 | 7.85 | -0.09 |
| HC S442E | 8.02 | 7.94 | 7.85 | -0.09 |
| HC L443D | 8.02 | 7.94 | 7.85 | -0.09 |
| HC L443E | 8.02 | 7.94 | 7.85 | -0.09 |
| HC S444D | 8.02 | 7.94 | 7.85 | -0.09 |
| HC S444E | 8.02 | 7.94 | 7.85 | -0.09 |
| HC P445D | 8.02 | 7.94 | 7.85 | -0.09 |
| HC P445E | 8.02 | 7.94 | 7.85 | -0.09 |
| HC G446D | 8.02 | 7.94 | 7.85 | -0.09 |
| HC G446E | 8.02 | 7.94 | 7.85 | -0.09 |
| HC K447D | 8.02 | 7.85 | 7.61 | -0.21 |
| HC K447E | 8.02 | 7.85 | 7.61 | -0.21 |

Figure 45

| | Basic to Neutral | | | |
|---|---|---|---|---|
| Variant | IgG1 / IgG1 | pI / IgG1 | pI / pI | delta pI |
| HC K121A | 8.38 | 8.32 | 8.24 | -0.07 |
| HC K121F | 8.38 | 8.32 | 8.24 | -0.07 |
| HC K121G | 8.38 | 8.32 | 8.24 | -0.07 |
| HC K121H | 8.38 | 8.32 | 8.24 | -0.07 |
| HC K121I | 8.38 | 8.32 | 8.24 | -0.07 |
| HC K121L | 8.38 | 8.32 | 8.24 | -0.07 |
| HC K121M | 8.38 | 8.32 | 8.24 | -0.07 |
| HC K121N | 8.38 | 8.32 | 8.24 | -0.07 |
| HC K121P | 8.38 | 8.32 | 8.24 | -0.07 |
| HC K121Q | 8.38 | 8.32 | 8.24 | -0.07 |
| HC K121S | 8.38 | 8.32 | 8.24 | -0.07 |
| HC K121T | 8.38 | 8.32 | 8.24 | -0.07 |
| HC K121V | 8.38 | 8.32 | 8.24 | -0.07 |
| HC K121W | 8.38 | 8.32 | 8.24 | -0.07 |
| HC K121Y | 8.38 | 8.31 | 8.24 | -0.07 |
| HC K133A | 8.38 | 8.32 | 8.24 | -0.07 |
| HC K133F | 8.38 | 8.32 | 8.24 | -0.07 |
| HC K133G | 8.38 | 8.32 | 8.24 | -0.07 |
| HC K133H | 8.38 | 8.32 | 8.24 | -0.07 |
| HC K133I | 8.38 | 8.32 | 8.24 | -0.07 |
| HC K133L | 8.38 | 8.32 | 8.24 | -0.07 |
| HC K133M | 8.38 | 8.32 | 8.24 | -0.07 |
| HC K133N | 8.38 | 8.32 | 8.24 | -0.07 |
| HC K133P | 8.38 | 8.32 | 8.24 | -0.07 |
| HC K133Q | 8.38 | 8.32 | 8.24 | -0.07 |
| HC K133S | 8.38 | 8.32 | 8.24 | -0.07 |
| HC K133T | 8.38 | 8.32 | 8.24 | -0.07 |
| HC K133V | 8.38 | 8.32 | 8.24 | -0.07 |
| HC K133W | 8.38 | 8.32 | 8.24 | -0.07 |
| HC K133Y | 8.38 | 8.31 | 8.24 | -0.07 |
| HC K205A | 8.38 | 8.32 | 8.24 | -0.07 |
| HC K205F | 8.38 | 8.32 | 8.24 | -0.07 |
| HC K205G | 8.38 | 8.32 | 8.24 | -0.07 |
| HC K205H | 8.38 | 8.32 | 8.24 | -0.07 |
| HC K205I | 8.38 | 8.32 | 8.24 | -0.07 |
| HC K205L | 8.38 | 8.32 | 8.24 | -0.07 |
| HC K205M | 8.38 | 8.32 | 8.24 | -0.07 |
| HC K205N | 8.38 | 8.32 | 8.24 | -0.07 |
| HC K205P | 8.38 | 8.32 | 8.24 | -0.07 |
| HC K205Q | 8.38 | 8.32 | 8.24 | -0.07 |
| HC K205S | 8.38 | 8.32 | 8.24 | -0.07 |
| HC K205T | 8.38 | 8.32 | 8.24 | -0.07 |
| HC K205V | 8.38 | 8.32 | 8.24 | -0.07 |
| HC K205W | 8.38 | 8.32 | 8.24 | -0.07 |
| HC K205Y | 8.38 | 8.31 | 8.24 | -0.07 |
| HC K210A | 8.38 | 8.32 | 8.24 | -0.07 |
| HC K210F | 8.38 | 8.32 | 8.24 | -0.07 |
| HC K210G | 8.38 | 8.32 | 8.24 | -0.07 |
| HC K210H | 8.38 | 8.32 | 8.24 | -0.07 |

Figure 45 (cont.)

| | | Basic to Neutral | | |
|---|---|---|---|---|
| Variant | IgG1 / IgG1 | pI / IgG1 | pI / pI | delta pI |
| HC K210I | 8.38 | 8.32 | 8.24 | -0.07 |
| HC K210L | 8.38 | 8.32 | 8.24 | -0.07 |
| HC K210M | 8.38 | 8.32 | 8.24 | -0.07 |
| HC K210N | 8.38 | 8.32 | 8.24 | -0.07 |
| HC K210P | 8.38 | 8.32 | 8.24 | -0.07 |
| HC K210Q | 8.38 | 8.32 | 8.24 | -0.07 |
| HC K210S | 8.38 | 8.32 | 8.24 | -0.07 |
| HC K210T | 8.38 | 8.32 | 8.24 | -0.07 |
| HC K210V | 8.38 | 8.32 | 8.24 | -0.07 |
| HC K210W | 8.38 | 8.32 | 8.24 | -0.07 |
| HC K210Y | 8.38 | 8.31 | 8.24 | -0.07 |
| HC K213A | 8.38 | 8.32 | 8.24 | -0.07 |
| HC K213F | 8.38 | 8.32 | 8.24 | -0.07 |
| HC K213G | 8.38 | 8.32 | 8.24 | -0.07 |
| HC K213H | 8.38 | 8.32 | 8.24 | -0.07 |
| HC K213I | 8.38 | 8.32 | 8.24 | -0.07 |
| HC K213L | 8.38 | 8.32 | 8.24 | -0.07 |
| HC K213M | 8.38 | 8.32 | 8.24 | -0.07 |
| HC K213N | 8.38 | 8.32 | 8.24 | -0.07 |
| HC K213P | 8.38 | 8.32 | 8.24 | -0.07 |
| HC K213Q | 8.38 | 8.32 | 8.24 | -0.07 |
| HC K213S | 8.38 | 8.32 | 8.24 | -0.07 |
| HC K213T | 8.38 | 8.32 | 8.24 | -0.07 |
| HC K213V | 8.38 | 8.32 | 8.24 | -0.07 |
| HC K213W | 8.38 | 8.32 | 8.24 | -0.07 |
| HC K213Y | 8.38 | 8.31 | 8.24 | -0.07 |
| HC K214A | 8.38 | 8.32 | 8.24 | -0.07 |
| HC K214F | 8.38 | 8.32 | 8.24 | -0.07 |
| HC K214G | 8.38 | 8.32 | 8.24 | -0.07 |
| HC K214H | 8.38 | 8.32 | 8.24 | -0.07 |
| HC K214I | 8.38 | 8.32 | 8.24 | -0.07 |
| HC K214L | 8.38 | 8.32 | 8.24 | -0.07 |
| HC K214M | 8.38 | 8.32 | 8.24 | -0.07 |
| HC K214N | 8.38 | 8.32 | 8.24 | -0.07 |
| HC K214P | 8.38 | 8.32 | 8.24 | -0.07 |
| HC K214Q | 8.38 | 8.32 | 8.24 | -0.07 |
| HC K214S | 8.38 | 8.32 | 8.24 | -0.07 |
| HC K214T | 8.38 | 8.32 | 8.24 | -0.07 |
| HC K214V | 8.38 | 8.32 | 8.24 | -0.07 |
| HC K214W | 8.38 | 8.32 | 8.24 | -0.07 |
| HC K214Y | 8.38 | 8.31 | 8.24 | -0.07 |
| HC K218A | 8.38 | 8.32 | 8.24 | -0.07 |
| HC K218F | 8.38 | 8.32 | 8.24 | -0.07 |
| HC K218G | 8.38 | 8.32 | 8.24 | -0.07 |
| HC K218H | 8.38 | 8.32 | 8.24 | -0.07 |
| HC K218I | 8.38 | 8.32 | 8.24 | -0.07 |
| HC K218L | 8.38 | 8.32 | 8.24 | -0.07 |
| HC K218M | 8.38 | 8.32 | 8.24 | -0.07 |
| HC K218N | 8.38 | 8.32 | 8.24 | -0.07 |
| HC K218P | 8.38 | 8.32 | 8.24 | -0.07 |
| HC K218Q | 8.38 | 8.32 | 8.24 | -0.07 |

Figure 45 (cont.)

| Variant | Basic to Neutral IgG1 / IgG1 | pI / IgG1 | pI / pI | delta pI |
|---|---|---|---|---|
| HC K218S | 8.38 | 8.32 | 8.24 | -0.07 |
| HC K218T | 8.38 | 8.32 | 8.24 | -0.07 |
| HC K218V | 8.38 | 8.32 | 8.24 | -0.07 |
| HC K218W | 8.38 | 8.32 | 8.24 | -0.07 |
| HC K218Y | 8.38 | 8.31 | 8.24 | -0.07 |
| HC K222A | 8.38 | 8.32 | 8.24 | -0.07 |
| HC K222F | 8.38 | 8.32 | 8.24 | -0.07 |
| HC K222G | 8.38 | 8.32 | 8.24 | -0.07 |
| HC K222H | 8.38 | 8.32 | 8.24 | -0.07 |
| HC K222I | 8.38 | 8.32 | 8.24 | -0.07 |
| HC K222L | 8.38 | 8.32 | 8.24 | -0.07 |
| HC K222M | 8.38 | 8.32 | 8.24 | -0.07 |
| HC K222N | 8.38 | 8.32 | 8.24 | -0.07 |
| HC K222P | 8.38 | 8.32 | 8.24 | -0.07 |
| HC K222Q | 8.38 | 8.32 | 8.24 | -0.07 |
| HC K222S | 8.38 | 8.32 | 8.24 | -0.07 |
| HC K222T | 8.38 | 8.32 | 8.24 | -0.07 |
| HC K222V | 8.38 | 8.32 | 8.24 | -0.07 |
| HC K222W | 8.38 | 8.32 | 8.24 | -0.07 |
| HC K222Y | 8.38 | 8.31 | 8.24 | -0.07 |
| HC K246A | 8.38 | 8.32 | 8.24 | -0.07 |
| HC K246F | 8.38 | 8.32 | 8.24 | -0.07 |
| HC K246G | 8.38 | 8.32 | 8.24 | -0.07 |
| HC K246H | 8.38 | 8.32 | 8.24 | -0.07 |
| HC K246I | 8.38 | 8.32 | 8.24 | -0.07 |
| HC K246L | 8.38 | 8.32 | 8.24 | -0.07 |
| HC K246M | 8.38 | 8.32 | 8.24 | -0.07 |
| HC K246N | 8.38 | 8.32 | 8.24 | -0.07 |
| HC K246P | 8.38 | 8.32 | 8.24 | -0.07 |
| HC K246Q | 8.38 | 8.32 | 8.24 | -0.07 |
| HC K246S | 8.38 | 8.32 | 8.24 | -0.07 |
| HC K246T | 8.38 | 8.32 | 8.24 | -0.07 |
| HC K246V | 8.38 | 8.32 | 8.24 | -0.07 |
| HC K246W | 8.38 | 8.32 | 8.24 | -0.07 |
| HC K246Y | 8.38 | 8.31 | 8.24 | -0.07 |
| HC R255A | 8.38 | 8.31 | 8.24 | -0.07 |
| HC R255F | 8.38 | 8.31 | 8.24 | -0.07 |
| HC R255G | 8.38 | 8.31 | 8.24 | -0.07 |
| HC R255H | 8.38 | 8.31 | 8.24 | -0.07 |
| HC R255I | 8.38 | 8.31 | 8.24 | -0.07 |
| HC R255L | 8.38 | 8.31 | 8.24 | -0.07 |
| HC R255M | 8.38 | 8.31 | 8.24 | -0.07 |
| HC R255N | 8.38 | 8.31 | 8.24 | -0.07 |
| HC R255P | 8.38 | 8.31 | 8.24 | -0.07 |
| HC R255Q | 8.38 | 8.31 | 8.24 | -0.07 |
| HC R255S | 8.38 | 8.31 | 8.24 | -0.07 |
| HC R255T | 8.38 | 8.31 | 8.24 | -0.07 |
| HC R255V | 8.38 | 8.31 | 8.24 | -0.07 |
| HC R255W | 8.38 | 8.31 | 8.24 | -0.07 |
| HC R255Y | 8.38 | 8.31 | 8.23 | -0.08 |
| HC K274A | 8.38 | 8.32 | 8.24 | -0.07 |

Figure 45 (cont.)

| Variant | Basic to Neutral | | | |
| --- | --- | --- | --- | --- |
| | IgG1 / IgG1 | pI / IgG1 | pI / pI | delta pI |
| HC K274F | 8.38 | 8.32 | 8.24 | -0.07 |
| HC K274G | 8.38 | 8.32 | 8.24 | -0.07 |
| HC K274H | 8.38 | 8.32 | 8.24 | -0.07 |
| HC K274I | 8.38 | 8.32 | 8.24 | -0.07 |
| HC K274L | 8.38 | 8.32 | 8.24 | -0.07 |
| HC K274M | 8.38 | 8.32 | 8.24 | -0.07 |
| HC K274N | 8.38 | 8.32 | 8.24 | -0.07 |
| HC K274P | 8.38 | 8.32 | 8.24 | -0.07 |
| HC K274Q | 8.38 | 8.32 | 8.24 | -0.07 |
| HC K274S | 8.38 | 8.32 | 8.24 | -0.07 |
| HC K274T | 8.38 | 8.32 | 8.24 | -0.07 |
| HC K274V | 8.38 | 8.32 | 8.24 | -0.07 |
| HC K274W | 8.38 | 8.32 | 8.24 | -0.07 |
| HC K274Y | 8.38 | 8.31 | 8.24 | -0.07 |
| HC K288A | 8.38 | 8.32 | 8.24 | -0.07 |
| HC K288F | 8.38 | 8.32 | 8.24 | -0.07 |
| HC K288G | 8.38 | 8.32 | 8.24 | -0.07 |
| HC K288H | 8.38 | 8.32 | 8.24 | -0.07 |
| HC K288I | 8.38 | 8.32 | 8.24 | -0.07 |
| HC K288L | 8.38 | 8.32 | 8.24 | -0.07 |
| HC K288M | 8.38 | 8.32 | 8.24 | -0.07 |
| HC K288N | 8.38 | 8.32 | 8.24 | -0.07 |
| HC K288P | 8.38 | 8.32 | 8.24 | -0.07 |
| HC K288Q | 8.38 | 8.32 | 8.24 | -0.07 |
| HC K288S | 8.38 | 8.32 | 8.24 | -0.07 |
| HC K288T | 8.38 | 8.32 | 8.24 | -0.07 |
| HC K288V | 8.38 | 8.32 | 8.24 | -0.07 |
| HC K288W | 8.38 | 8.32 | 8.24 | -0.07 |
| HC K288Y | 8.38 | 8.31 | 8.24 | -0.07 |
| HC K290A | 8.38 | 8.32 | 8.24 | -0.07 |
| HC K290F | 8.38 | 8.32 | 8.24 | -0.07 |
| HC K290G | 8.38 | 8.32 | 8.24 | -0.07 |
| HC K290H | 8.38 | 8.32 | 8.24 | -0.07 |
| HC K290I | 8.38 | 8.32 | 8.24 | -0.07 |
| HC K290L | 8.38 | 8.32 | 8.24 | -0.07 |
| HC K290M | 8.38 | 8.32 | 8.24 | -0.07 |
| HC K290N | 8.38 | 8.32 | 8.24 | -0.07 |
| HC K290P | 8.38 | 8.32 | 8.24 | -0.07 |
| HC K290Q | 8.38 | 8.32 | 8.24 | -0.07 |
| HC K290S | 8.38 | 8.32 | 8.24 | -0.07 |
| HC K290T | 8.38 | 8.32 | 8.24 | -0.07 |
| HC K290V | 8.38 | 8.32 | 8.24 | -0.07 |
| HC K290W | 8.38 | 8.32 | 8.24 | -0.07 |
| HC K290Y | 8.38 | 8.31 | 8.24 | -0.07 |
| HC R292A | 8.38 | 8.31 | 8.24 | -0.07 |
| HC R292F | 8.38 | 8.31 | 8.24 | -0.07 |
| HC R292G | 8.38 | 8.31 | 8.24 | -0.07 |
| HC R292H | 8.38 | 8.31 | 8.24 | -0.07 |
| HC R292I | 8.38 | 8.31 | 8.24 | -0.07 |
| HC R292L | 8.38 | 8.31 | 8.24 | -0.07 |
| HC R292M | 8.38 | 8.31 | 8.24 | -0.07 |

Figure 45 (cont.)

| Variant | Basic to Neutral IgG1 / IgG1 | pI / IgG1 | pI / pI | delta pI |
|---|---|---|---|---|
| HC R292N | 8.38 | 8.31 | 8.24 | -0.07 |
| HC R292P | 8.38 | 8.31 | 8.24 | -0.07 |
| HC R292Q | 8.38 | 8.31 | 8.24 | -0.07 |
| HC R292S | 8.38 | 8.31 | 8.24 | -0.07 |
| HC R292T | 8.38 | 8.31 | 8.24 | -0.07 |
| HC R292V | 8.38 | 8.31 | 8.24 | -0.07 |
| HC R292W | 8.38 | 8.31 | 8.24 | -0.07 |
| HC R292Y | 8.38 | 8.31 | 8.23 | -0.08 |
| HC R301A | 8.38 | 8.31 | 8.24 | -0.07 |
| HC R301F | 8.38 | 8.31 | 8.24 | -0.07 |
| HC R301G | 8.38 | 8.31 | 8.24 | -0.07 |
| HC R301H | 8.38 | 8.31 | 8.24 | -0.07 |
| HC R301I | 8.38 | 8.31 | 8.24 | -0.07 |
| HC R301L | 8.38 | 8.31 | 8.24 | -0.07 |
| HC R301M | 8.38 | 8.31 | 8.24 | -0.07 |
| HC R301N | 8.38 | 8.31 | 8.24 | -0.07 |
| HC R301P | 8.38 | 8.31 | 8.24 | -0.07 |
| HC R301Q | 8.38 | 8.31 | 8.24 | -0.07 |
| HC R301S | 8.38 | 8.31 | 8.24 | -0.07 |
| HC R301T | 8.38 | 8.31 | 8.24 | -0.07 |
| HC R301V | 8.38 | 8.31 | 8.24 | -0.07 |
| HC R301W | 8.38 | 8.31 | 8.24 | -0.07 |
| HC R301Y | 8.38 | 8.31 | 8.23 | -0.08 |
| HC K317A | 8.38 | 8.32 | 8.24 | -0.07 |
| HC K317F | 8.38 | 8.32 | 8.24 | -0.07 |
| HC K317G | 8.38 | 8.32 | 8.24 | -0.07 |
| HC K317H | 8.38 | 8.32 | 8.24 | -0.07 |
| HC K317I | 8.38 | 8.32 | 8.24 | -0.07 |
| HC K317L | 8.38 | 8.32 | 8.24 | -0.07 |
| HC K317M | 8.38 | 8.32 | 8.24 | -0.07 |
| HC K317N | 8.38 | 8.32 | 8.24 | -0.07 |
| HC K317P | 8.38 | 8.32 | 8.24 | -0.07 |
| HC K317Q | 8.38 | 8.32 | 8.24 | -0.07 |
| HC K317S | 8.38 | 8.32 | 8.24 | -0.07 |
| HC K317T | 8.38 | 8.32 | 8.24 | -0.07 |
| HC K317V | 8.38 | 8.32 | 8.24 | -0.07 |
| HC K317W | 8.38 | 8.32 | 8.24 | -0.07 |
| HC K317Y | 8.38 | 8.31 | 8.24 | -0.07 |
| HC K320A | 8.38 | 8.32 | 8.24 | -0.07 |
| HC K320F | 8.38 | 8.32 | 8.24 | -0.07 |
| HC K320G | 8.38 | 8.32 | 8.24 | -0.07 |
| HC K320H | 8.38 | 8.32 | 8.24 | -0.07 |
| HC K320I | 8.38 | 8.32 | 8.24 | -0.07 |
| HC K320L | 8.38 | 8.32 | 8.24 | -0.07 |
| HC K320M | 8.38 | 8.32 | 8.24 | -0.07 |
| HC K320N | 8.38 | 8.32 | 8.24 | -0.07 |
| HC K320P | 8.38 | 8.32 | 8.24 | -0.07 |
| HC K320Q | 8.38 | 8.32 | 8.24 | -0.07 |
| HC K320S | 8.38 | 8.32 | 8.24 | -0.07 |
| HC K320T | 8.38 | 8.32 | 8.24 | -0.07 |
| HC K320V | 8.38 | 8.32 | 8.24 | -0.07 |

Figure 45 (cont.)

| Variant | Basic to Neutral IgG1 / IgG1 | pI / IgG1 | pI / pI | delta pI |
|---|---|---|---|---|
| HC K320W | 8.38 | 8.32 | 8.24 | -0.07 |
| HC K320Y | 8.38 | 8.31 | 8.24 | -0.07 |
| HC K322A | 8.38 | 8.32 | 8.24 | -0.07 |
| HC K322F | 8.38 | 8.32 | 8.24 | -0.07 |
| HC K322G | 8.38 | 8.32 | 8.24 | -0.07 |
| HC K322H | 8.38 | 8.32 | 8.24 | -0.07 |
| HC K322I | 8.38 | 8.32 | 8.24 | -0.07 |
| HC K322L | 8.38 | 8.32 | 8.24 | -0.07 |
| HC K322M | 8.38 | 8.32 | 8.24 | -0.07 |
| HC K322N | 8.38 | 8.32 | 8.24 | -0.07 |
| HC K322P | 8.38 | 8.32 | 8.24 | -0.07 |
| HC K322Q | 8.38 | 8.32 | 8.24 | -0.07 |
| HC K322S | 8.38 | 8.32 | 8.24 | -0.07 |
| HC K322T | 8.38 | 8.32 | 8.24 | -0.07 |
| HC K322V | 8.38 | 8.32 | 8.24 | -0.07 |
| HC K322W | 8.38 | 8.32 | 8.24 | -0.07 |
| HC K322Y | 8.38 | 8.31 | 8.24 | -0.07 |
| HC K326A | 8.38 | 8.32 | 8.24 | -0.07 |
| HC K326F | 8.38 | 8.32 | 8.24 | -0.07 |
| HC K326G | 8.38 | 8.32 | 8.24 | -0.07 |
| HC K326H | 8.38 | 8.32 | 8.24 | -0.07 |
| HC K326I | 8.38 | 8.32 | 8.24 | -0.07 |
| HC K326L | 8.38 | 8.32 | 8.24 | -0.07 |
| HC K326M | 8.38 | 8.32 | 8.24 | -0.07 |
| HC K326N | 8.38 | 8.32 | 8.24 | -0.07 |
| HC K326P | 8.38 | 8.32 | 8.24 | -0.07 |
| HC K326Q | 8.38 | 8.32 | 8.24 | -0.07 |
| HC K326S | 8.38 | 8.32 | 8.24 | -0.07 |
| HC K326T | 8.38 | 8.32 | 8.24 | -0.07 |
| HC K326V | 8.38 | 8.32 | 8.24 | -0.07 |
| HC K326W | 8.38 | 8.32 | 8.24 | -0.07 |
| HC K326Y | 8.38 | 8.31 | 8.24 | -0.07 |
| HC K334A | 8.38 | 8.32 | 8.24 | -0.07 |
| HC K334F | 8.38 | 8.32 | 8.24 | -0.07 |
| HC K334G | 8.38 | 8.32 | 8.24 | -0.07 |
| HC K334H | 8.38 | 8.32 | 8.24 | -0.07 |
| HC K334I | 8.38 | 8.32 | 8.24 | -0.07 |
| HC K334L | 8.38 | 8.32 | 8.24 | -0.07 |
| HC K334M | 8.38 | 8.32 | 8.24 | -0.07 |
| HC K334N | 8.38 | 8.32 | 8.24 | -0.07 |
| HC K334P | 8.38 | 8.32 | 8.24 | -0.07 |
| HC K334Q | 8.38 | 8.32 | 8.24 | -0.07 |
| HC K334S | 8.38 | 8.32 | 8.24 | -0.07 |
| HC K334T | 8.38 | 8.32 | 8.24 | -0.07 |
| HC K334V | 8.38 | 8.32 | 8.24 | -0.07 |
| HC K334W | 8.38 | 8.32 | 8.24 | -0.07 |
| HC K334Y | 8.38 | 8.31 | 8.24 | -0.07 |
| HC K340A | 8.38 | 8.32 | 8.24 | -0.07 |
| HC K340F | 8.38 | 8.32 | 8.24 | -0.07 |
| HC K340G | 8.38 | 8.32 | 8.24 | -0.07 |
| HC K340H | 8.38 | 8.32 | 8.24 | -0.07 |

Figure 45 (cont.)

| Variant | Basic to Neutral | | | |
| --- | --- | --- | --- | --- |
| | IgG1 / IgG1 | pI / IgG1 | pI / pI | delta pI |
| HC K340I | 8.38 | 8.32 | 8.24 | -0.07 |
| HC K340L | 8.38 | 8.32 | 8.24 | -0.07 |
| HC K340M | 8.38 | 8.32 | 8.24 | -0.07 |
| HC K340N | 8.38 | 8.32 | 8.24 | -0.07 |
| HC K340P | 8.38 | 8.32 | 8.24 | -0.07 |
| HC K340Q | 8.38 | 8.32 | 8.24 | -0.07 |
| HC K340S | 8.38 | 8.32 | 8.24 | -0.07 |
| HC K340T | 8.38 | 8.32 | 8.24 | -0.07 |
| HC K340V | 8.38 | 8.32 | 8.24 | -0.07 |
| HC K340W | 8.38 | 8.32 | 8.24 | -0.07 |
| HC K340Y | 8.38 | 8.31 | 8.24 | -0.07 |
| HC R344A | 8.38 | 8.31 | 8.24 | -0.07 |
| HC R344F | 8.38 | 8.31 | 8.24 | -0.07 |
| HC R344G | 8.38 | 8.31 | 8.24 | -0.07 |
| HC R344H | 8.38 | 8.31 | 8.24 | -0.07 |
| HC R344I | 8.38 | 8.31 | 8.24 | -0.07 |
| HC R344L | 8.38 | 8.31 | 8.24 | -0.07 |
| HC R344M | 8.38 | 8.31 | 8.24 | -0.07 |
| HC R344N | 8.38 | 8.31 | 8.24 | -0.07 |
| HC R344P | 8.38 | 8.31 | 8.24 | -0.07 |
| HC R344Q | 8.38 | 8.31 | 8.24 | -0.07 |
| HC R344S | 8.38 | 8.31 | 8.24 | -0.07 |
| HC R344T | 8.38 | 8.31 | 8.24 | -0.07 |
| HC R344V | 8.38 | 8.31 | 8.24 | -0.07 |
| HC R344W | 8.38 | 8.31 | 8.24 | -0.07 |
| HC R344Y | 8.38 | 8.31 | 8.23 | -0.08 |
| HC R355A | 8.38 | 8.31 | 8.24 | -0.07 |
| HC R355F | 8.38 | 8.31 | 8.24 | -0.07 |
| HC R355G | 8.38 | 8.31 | 8.24 | -0.07 |
| HC R355H | 8.38 | 8.31 | 8.24 | -0.07 |
| HC R355I | 8.38 | 8.31 | 8.24 | -0.07 |
| HC R355L | 8.38 | 8.31 | 8.24 | -0.07 |
| HC R355M | 8.38 | 8.31 | 8.24 | -0.07 |
| HC R355N | 8.38 | 8.31 | 8.24 | -0.07 |
| HC R355P | 8.38 | 8.31 | 8.24 | -0.07 |
| HC R355Q | 8.38 | 8.31 | 8.24 | -0.07 |
| HC R355S | 8.38 | 8.31 | 8.24 | -0.07 |
| HC R355T | 8.38 | 8.31 | 8.24 | -0.07 |
| HC R355V | 8.38 | 8.31 | 8.24 | -0.07 |
| HC R355W | 8.38 | 8.31 | 8.24 | -0.07 |
| HC R355Y | 8.38 | 8.31 | 8.23 | -0.08 |
| HC K360A | 8.38 | 8.32 | 8.24 | -0.07 |
| HC K360F | 8.38 | 8.32 | 8.24 | -0.07 |
| HC K360G | 8.38 | 8.32 | 8.24 | -0.07 |
| HC K360H | 8.38 | 8.32 | 8.24 | -0.07 |
| HC K360I | 8.38 | 8.32 | 8.24 | -0.07 |
| HC K360L | 8.38 | 8.32 | 8.24 | -0.07 |
| HC K360M | 8.38 | 8.32 | 8.24 | -0.07 |
| HC K360N | 8.38 | 8.32 | 8.24 | -0.07 |
| HC K360P | 8.38 | 8.32 | 8.24 | -0.07 |
| HC K360Q | 8.38 | 8.32 | 8.24 | -0.07 |

Figure 45 (cont.)

| Variant | Basic to Neutral IgG1 / IgG1 | pI / IgG1 | pI / pI | delta pI |
|---|---|---|---|---|
| HC K360S | 8.38 | 8.32 | 8.24 | -0.07 |
| HC K360T | 8.38 | 8.32 | 8.24 | -0.07 |
| HC K360V | 8.38 | 8.32 | 8.24 | -0.07 |
| HC K360W | 8.38 | 8.32 | 8.24 | -0.07 |
| HC K360Y | 8.38 | 8.31 | 8.24 | -0.07 |
| HC K392A | 8.38 | 8.32 | 8.24 | -0.07 |
| HC K392F | 8.38 | 8.32 | 8.24 | -0.07 |
| HC K392G | 8.38 | 8.32 | 8.24 | -0.07 |
| HC K392H | 8.38 | 8.32 | 8.24 | -0.07 |
| HC K392I | 8.38 | 8.32 | 8.24 | -0.07 |
| HC K392L | 8.38 | 8.32 | 8.24 | -0.07 |
| HC K392M | 8.38 | 8.32 | 8.24 | -0.07 |
| HC K392N | 8.38 | 8.32 | 8.24 | -0.07 |
| HC K392P | 8.38 | 8.32 | 8.24 | -0.07 |
| HC K392Q | 8.38 | 8.32 | 8.24 | -0.07 |
| HC K392S | 8.38 | 8.32 | 8.24 | -0.07 |
| HC K392T | 8.38 | 8.32 | 8.24 | -0.07 |
| HC K392V | 8.38 | 8.32 | 8.24 | -0.07 |
| HC K392W | 8.38 | 8.32 | 8.24 | -0.07 |
| HC K392Y | 8.38 | 8.31 | 8.24 | -0.07 |
| HC K414A | 8.38 | 8.32 | 8.24 | -0.07 |
| HC K414F | 8.38 | 8.32 | 8.24 | -0.07 |
| HC K414G | 8.38 | 8.32 | 8.24 | -0.07 |
| HC K414H | 8.38 | 8.32 | 8.24 | -0.07 |
| HC K414I | 8.38 | 8.32 | 8.24 | -0.07 |
| HC K414L | 8.38 | 8.32 | 8.24 | -0.07 |
| HC K414M | 8.38 | 8.32 | 8.24 | -0.07 |
| HC K414N | 8.38 | 8.32 | 8.24 | -0.07 |
| HC K414P | 8.38 | 8.32 | 8.24 | -0.07 |
| HC K414Q | 8.38 | 8.32 | 8.24 | -0.07 |
| HC K414S | 8.38 | 8.32 | 8.24 | -0.07 |
| HC K414T | 8.38 | 8.32 | 8.24 | -0.07 |
| HC K414V | 8.38 | 8.32 | 8.24 | -0.07 |
| HC K414W | 8.38 | 8.32 | 8.24 | -0.07 |
| HC K414Y | 8.38 | 8.31 | 8.24 | -0.07 |
| HC R416A | 8.38 | 8.31 | 8.24 | -0.07 |
| HC R416F | 8.38 | 8.31 | 8.24 | -0.07 |
| HC R416G | 8.38 | 8.31 | 8.24 | -0.07 |
| HC R416H | 8.38 | 8.31 | 8.24 | -0.07 |
| HC R416I | 8.38 | 8.31 | 8.24 | -0.07 |
| HC R416L | 8.38 | 8.31 | 8.24 | -0.07 |
| HC R416M | 8.38 | 8.31 | 8.24 | -0.07 |
| HC R416N | 8.38 | 8.31 | 8.24 | -0.07 |
| HC R416P | 8.38 | 8.31 | 8.24 | -0.07 |
| HC R416Q | 8.38 | 8.31 | 8.24 | -0.07 |
| HC R416S | 8.38 | 8.31 | 8.24 | -0.07 |
| HC R416T | 8.38 | 8.31 | 8.24 | -0.07 |
| HC R416V | 8.38 | 8.31 | 8.24 | -0.07 |
| HC R416W | 8.38 | 8.31 | 8.24 | -0.07 |
| HC R416Y | 8.38 | 8.31 | 8.23 | -0.08 |
| HC K439A | 8.38 | 8.32 | 8.24 | -0.07 |

Figure 45 (cont.)

| Variant | Basic to Neutral IgG1 / IgG1 | pI / IgG1 | pI / pI | delta pI |
|---|---|---|---|---|
| HC K439F | 8.38 | 8.32 | 8.24 | -0.07 |
| HC K439G | 8.38 | 8.32 | 8.24 | -0.07 |
| HC K439H | 8.38 | 8.32 | 8.24 | -0.07 |
| HC K439I | 8.38 | 8.32 | 8.24 | -0.07 |
| HC K439L | 8.38 | 8.32 | 8.24 | -0.07 |
| HC K439M | 8.38 | 8.32 | 8.24 | -0.07 |
| HC K439N | 8.38 | 8.32 | 8.24 | -0.07 |
| HC K439P | 8.38 | 8.32 | 8.24 | -0.07 |
| HC K439Q | 8.38 | 8.32 | 8.24 | -0.07 |
| HC K439S | 8.38 | 8.32 | 8.24 | -0.07 |
| HC K439T | 8.38 | 8.32 | 8.24 | -0.07 |
| HC K439V | 8.38 | 8.32 | 8.24 | -0.07 |
| HC K439W | 8.38 | 8.32 | 8.24 | -0.07 |
| HC K439Y | 8.38 | 8.31 | 8.24 | -0.07 |
| HC K447A | 8.38 | 8.32 | 8.24 | -0.07 |
| HC K447F | 8.38 | 8.32 | 8.24 | -0.07 |
| HC K447G | 8.38 | 8.32 | 8.24 | -0.07 |
| HC K447H | 8.38 | 8.32 | 8.24 | -0.07 |
| HC K447I | 8.38 | 8.32 | 8.24 | -0.07 |
| HC K447L | 8.38 | 8.32 | 8.24 | -0.07 |
| HC K447M | 8.38 | 8.32 | 8.24 | -0.07 |
| HC K447N | 8.38 | 8.32 | 8.24 | -0.07 |
| HC K447P | 8.38 | 8.32 | 8.24 | -0.07 |
| HC K447Q | 8.38 | 8.32 | 8.24 | -0.07 |
| HC K447S | 8.38 | 8.32 | 8.24 | -0.07 |
| HC K447T | 8.38 | 8.32 | 8.24 | -0.07 |
| HC K447V | 8.38 | 8.32 | 8.24 | -0.07 |
| HC K447W | 8.38 | 8.32 | 8.24 | -0.07 |
| HC K447Y | 8.38 | 8.31 | 8.24 | -0.07 |

Figure 46

| Variant | Neutral or Acidic to Basic | | | |
|---|---|---|---|---|
| | IgG1 / IgG1 | pI / IgG1 | pI / pI | delta pI |
| HC S119K | 8.38 | 8.45 | 8.50 | 0.06 |
| HC S119R | 8.38 | 8.45 | 8.50 | 0.06 |
| HC T120K | 8.38 | 8.45 | 8.50 | 0.06 |
| HC T120R | 8.38 | 8.45 | 8.50 | 0.06 |
| HC G122K | 8.38 | 8.45 | 8.50 | 0.06 |
| HC G122R | 8.38 | 8.45 | 8.50 | 0.06 |
| HC S131K | 8.38 | 8.45 | 8.50 | 0.06 |
| HC S131R | 8.38 | 8.45 | 8.50 | 0.06 |
| HC S132K | 8.38 | 8.45 | 8.50 | 0.06 |
| HC S132R | 8.38 | 8.45 | 8.50 | 0.06 |
| HC S134K | 8.38 | 8.45 | 8.50 | 0.06 |
| HC S134R | 8.38 | 8.45 | 8.50 | 0.06 |
| HC T135K | 8.38 | 8.45 | 8.50 | 0.06 |
| HC T135R | 8.38 | 8.45 | 8.50 | 0.06 |
| HC S136K | 8.38 | 8.45 | 8.50 | 0.06 |
| HC S136R | 8.38 | 8.45 | 8.50 | 0.06 |
| HC G137K | 8.38 | 8.45 | 8.50 | 0.06 |
| HC G137R | 8.38 | 8.45 | 8.50 | 0.06 |
| HC G138K | 8.38 | 8.45 | 8.50 | 0.06 |
| HC G138R | 8.38 | 8.45 | 8.50 | 0.06 |
| HC T139K | 8.38 | 8.45 | 8.50 | 0.06 |
| HC T139R | 8.38 | 8.45 | 8.50 | 0.06 |
| HC D148K | 8.38 | 8.50 | 8.60 | 0.11 |
| HC D148R | 8.38 | 8.50 | 8.61 | 0.11 |
| HC E152K | 8.38 | 8.50 | 8.60 | 0.11 |
| HC E152R | 8.38 | 8.50 | 8.61 | 0.11 |
| HC P153K | 8.38 | 8.45 | 8.50 | 0.06 |
| HC P153R | 8.38 | 8.45 | 8.50 | 0.06 |
| HC T155K | 8.38 | 8.45 | 8.50 | 0.06 |
| HC T155R | 8.38 | 8.45 | 8.50 | 0.06 |
| HC S157K | 8.38 | 8.45 | 8.50 | 0.06 |
| HC S157R | 8.38 | 8.45 | 8.50 | 0.06 |
| HC N159K | 8.38 | 8.45 | 8.50 | 0.06 |
| HC N159R | 8.38 | 8.45 | 8.50 | 0.06 |
| HC S160K | 8.38 | 8.45 | 8.50 | 0.06 |
| HC S160R | 8.38 | 8.45 | 8.50 | 0.06 |
| HC G161K | 8.38 | 8.45 | 8.50 | 0.06 |
| HC G161R | 8.38 | 8.45 | 8.50 | 0.06 |
| HC A162K | 8.38 | 8.45 | 8.50 | 0.06 |
| HC A162R | 8.38 | 8.45 | 8.50 | 0.06 |
| HC T164K | 8.38 | 8.45 | 8.50 | 0.06 |
| HC T164R | 8.38 | 8.45 | 8.50 | 0.06 |
| HC S165K | 8.38 | 8.45 | 8.50 | 0.06 |
| HC S165R | 8.38 | 8.45 | 8.50 | 0.06 |
| HC G166K | 8.38 | 8.45 | 8.50 | 0.06 |
| HC G166R | 8.38 | 8.45 | 8.50 | 0.06 |
| HC T169K | 8.38 | 8.45 | 8.50 | 0.06 |
| HC T169R | 8.38 | 8.45 | 8.50 | 0.06 |
| HC P171K | 8.38 | 8.45 | 8.50 | 0.06 |

Figure 46 (cont.)

| Variant | Neutral or Acidic to Basic | | | |
|---|---|---|---|---|
| | IgG1 / IgG1 | pI / IgG1 | pI / pI | delta pI |
| HC P171R | 8.38 | 8.45 | 8.50 | 0.06 |
| HC A172K | 8.38 | 8.45 | 8.50 | 0.06 |
| HC A172R | 8.38 | 8.45 | 8.50 | 0.06 |
| HC L174K | 8.38 | 8.45 | 8.50 | 0.06 |
| HC L174R | 8.38 | 8.45 | 8.50 | 0.06 |
| HC S176K | 8.38 | 8.45 | 8.50 | 0.06 |
| HC S176R | 8.38 | 8.45 | 8.50 | 0.06 |
| HC S177K | 8.38 | 8.45 | 8.50 | 0.06 |
| HC S177R | 8.38 | 8.45 | 8.50 | 0.06 |
| HC T187K | 8.38 | 8.45 | 8.50 | 0.06 |
| HC T187R | 8.38 | 8.45 | 8.50 | 0.06 |
| HC P189K | 8.38 | 8.45 | 8.50 | 0.06 |
| HC P189R | 8.38 | 8.45 | 8.50 | 0.06 |
| HC S190K | 8.38 | 8.45 | 8.50 | 0.06 |
| HC S190R | 8.38 | 8.45 | 8.50 | 0.06 |
| HC S191K | 8.38 | 8.45 | 8.50 | 0.06 |
| HC S191R | 8.38 | 8.45 | 8.50 | 0.06 |
| HC L193K | 8.38 | 8.45 | 8.50 | 0.06 |
| HC L193R | 8.38 | 8.45 | 8.50 | 0.06 |
| HC G194K | 8.38 | 8.45 | 8.50 | 0.06 |
| HC G194R | 8.38 | 8.45 | 8.50 | 0.06 |
| HC T195K | 8.38 | 8.45 | 8.50 | 0.06 |
| HC T195R | 8.38 | 8.45 | 8.50 | 0.06 |
| HC Q196K | 8.38 | 8.45 | 8.50 | 0.06 |
| HC Q196R | 8.38 | 8.45 | 8.50 | 0.06 |
| HC T197K | 8.38 | 8.45 | 8.50 | 0.06 |
| HC T197R | 8.38 | 8.45 | 8.50 | 0.06 |
| HC I199K | 8.38 | 8.45 | 8.50 | 0.06 |
| HC I199R | 8.38 | 8.45 | 8.50 | 0.06 |
| HC N203K | 8.38 | 8.45 | 8.50 | 0.06 |
| HC N203R | 8.38 | 8.45 | 8.50 | 0.06 |
| HC P206K | 8.38 | 8.45 | 8.50 | 0.06 |
| HC P206R | 8.38 | 8.45 | 8.50 | 0.06 |
| HC S207K | 8.38 | 8.45 | 8.50 | 0.06 |
| HC S207R | 8.38 | 8.45 | 8.50 | 0.06 |
| HC N208K | 8.38 | 8.45 | 8.50 | 0.06 |
| HC N208R | 8.38 | 8.45 | 8.50 | 0.06 |
| HC T209K | 8.38 | 8.45 | 8.50 | 0.06 |
| HC T209R | 8.38 | 8.45 | 8.50 | 0.06 |
| HC V211K | 8.38 | 8.45 | 8.50 | 0.06 |
| HC V211R | 8.38 | 8.45 | 8.50 | 0.06 |
| HC D212K | 8.38 | 8.50 | 8.60 | 0.11 |
| HC D212R | 8.38 | 8.50 | 8.61 | 0.11 |
| HC E216K | 8.38 | 8.50 | 8.60 | 0.11 |
| HC E216R | 8.38 | 8.50 | 8.61 | 0.11 |
| HC P217K | 8.38 | 8.45 | 8.50 | 0.06 |
| HC P217R | 8.38 | 8.45 | 8.50 | 0.06 |
| HC S219K | 8.38 | 8.45 | 8.50 | 0.06 |
| HC S219R | 8.38 | 8.45 | 8.50 | 0.06 |
| HC C220K | 8.38 | 8.46 | 8.53 | 0.07 |
| HC C220R | 8.38 | 8.46 | 8.53 | 0.07 |

Figure 46 (cont.)

| Variant | Neutral or Acidic to Basic | | | |
|---|---|---|---|---|
| | IgG1 / IgG1 | pI / IgG1 | pI / pI | delta pI |
| HC D221K | 8.38 | 8.50 | 8.60 | 0.11 |
| HC D221R | 8.38 | 8.50 | 8.61 | 0.11 |
| HC T223K | 8.38 | 8.45 | 8.50 | 0.06 |
| HC T223R | 8.38 | 8.45 | 8.50 | 0.06 |
| HC H224K | 8.38 | 8.44 | 8.50 | 0.06 |
| HC H224R | 8.38 | 8.45 | 8.50 | 0.06 |
| HC T225K | 8.38 | 8.45 | 8.50 | 0.06 |
| HC T225R | 8.38 | 8.45 | 8.50 | 0.06 |
| HC C226K | 8.38 | 8.46 | 8.53 | 0.07 |
| HC C226R | 8.38 | 8.46 | 8.53 | 0.07 |
| HC P227K | 8.38 | 8.45 | 8.50 | 0.06 |
| HC P227R | 8.38 | 8.45 | 8.50 | 0.06 |
| HC P228K | 8.38 | 8.45 | 8.50 | 0.06 |
| HC P228R | 8.38 | 8.45 | 8.50 | 0.06 |
| HC C229K | 8.38 | 8.46 | 8.53 | 0.07 |
| HC C229R | 8.38 | 8.46 | 8.53 | 0.07 |
| HC P230K | 8.38 | 8.45 | 8.50 | 0.06 |
| HC P230R | 8.38 | 8.45 | 8.50 | 0.06 |
| HC A231K | 8.38 | 8.45 | 8.50 | 0.06 |
| HC A231R | 8.38 | 8.45 | 8.50 | 0.06 |
| HC P232K | 8.38 | 8.45 | 8.50 | 0.06 |
| HC P232R | 8.38 | 8.45 | 8.50 | 0.06 |
| HC E233K | 8.38 | 8.50 | 8.60 | 0.11 |
| HC E233R | 8.38 | 8.50 | 8.61 | 0.11 |
| HC L234K | 8.38 | 8.45 | 8.50 | 0.06 |
| HC L234R | 8.38 | 8.45 | 8.50 | 0.06 |
| HC L235K | 8.38 | 8.45 | 8.50 | 0.06 |
| HC L235R | 8.38 | 8.45 | 8.50 | 0.06 |
| HC G236K | 8.38 | 8.45 | 8.50 | 0.06 |
| HC G236R | 8.38 | 8.45 | 8.50 | 0.06 |
| HC S239K | 8.38 | 8.45 | 8.50 | 0.06 |
| HC S239R | 8.38 | 8.45 | 8.50 | 0.06 |
| HC F241K | 8.38 | 8.45 | 8.50 | 0.06 |
| HC F241R | 8.38 | 8.45 | 8.50 | 0.06 |
| HC F243K | 8.38 | 8.45 | 8.50 | 0.06 |
| HC F243R | 8.38 | 8.45 | 8.50 | 0.06 |
| HC P244K | 8.38 | 8.45 | 8.50 | 0.06 |
| HC P244R | 8.38 | 8.45 | 8.50 | 0.06 |
| HC P247K | 8.38 | 8.45 | 8.50 | 0.06 |
| HC P247R | 8.38 | 8.45 | 8.50 | 0.06 |
| HC M252K | 8.38 | 8.45 | 8.50 | 0.06 |
| HC M252R | 8.38 | 8.45 | 8.50 | 0.06 |
| HC I253K | 8.38 | 8.45 | 8.50 | 0.06 |
| HC I253R | 8.38 | 8.45 | 8.50 | 0.06 |
| HC S254K | 8.38 | 8.45 | 8.50 | 0.06 |
| HC S254R | 8.38 | 8.45 | 8.50 | 0.06 |
| HC T256K | 8.38 | 8.45 | 8.50 | 0.06 |
| HC T256R | 8.38 | 8.45 | 8.50 | 0.06 |
| HC E258K | 8.38 | 8.50 | 8.60 | 0.11 |
| HC E258R | 8.38 | 8.50 | 8.61 | 0.11 |
| HC V264K | 8.38 | 8.45 | 8.50 | 0.06 |

Figure 46 (cont.)

| Variant | Neutral or Acidic to Basic | | | |
|---|---|---|---|---|
| | IgG1 / IgG1 | pI / IgG1 | pI / pI | delta pI |
| HC V264R | 8.38 | 8.45 | 8.50 | 0.06 |
| HC D265K | 8.38 | 8.50 | 8.60 | 0.11 |
| HC D265R | 8.38 | 8.50 | 8.61 | 0.11 |
| HC H268K | 8.38 | 8.44 | 8.50 | 0.06 |
| HC H268R | 8.38 | 8.45 | 8.50 | 0.06 |
| HC E269K | 8.38 | 8.50 | 8.60 | 0.11 |
| HC E269R | 8.38 | 8.50 | 8.61 | 0.11 |
| HC P271K | 8.38 | 8.45 | 8.50 | 0.06 |
| HC P271R | 8.38 | 8.45 | 8.50 | 0.06 |
| HC E272K | 8.38 | 8.50 | 8.60 | 0.11 |
| HC E272R | 8.38 | 8.50 | 8.61 | 0.11 |
| HC Y278K | 8.38 | 8.45 | 8.50 | 0.06 |
| HC Y278R | 8.38 | 8.45 | 8.51 | 0.06 |
| HC D280K | 8.38 | 8.50 | 8.60 | 0.11 |
| HC D280R | 8.38 | 8.50 | 8.61 | 0.11 |
| HC G281K | 8.38 | 8.45 | 8.50 | 0.06 |
| HC G281R | 8.38 | 8.45 | 8.50 | 0.06 |
| HC V282K | 8.38 | 8.45 | 8.50 | 0.06 |
| HC V282R | 8.38 | 8.45 | 8.50 | 0.06 |
| HC E283K | 8.38 | 8.50 | 8.60 | 0.11 |
| HC E283R | 8.38 | 8.50 | 8.61 | 0.11 |
| HC V284K | 8.38 | 8.45 | 8.50 | 0.06 |
| HC V284R | 8.38 | 8.45 | 8.50 | 0.06 |
| HC H285K | 8.38 | 8.44 | 8.50 | 0.06 |
| HC H285R | 8.38 | 8.45 | 8.50 | 0.06 |
| HC N286K | 8.38 | 8.45 | 8.50 | 0.06 |
| HC N286R | 8.38 | 8.45 | 8.50 | 0.06 |
| HC A287K | 8.38 | 8.45 | 8.50 | 0.06 |
| HC A287R | 8.38 | 8.45 | 8.50 | 0.06 |
| HC T289K | 8.38 | 8.45 | 8.50 | 0.06 |
| HC T289R | 8.38 | 8.45 | 8.50 | 0.06 |
| HC P291K | 8.38 | 8.45 | 8.50 | 0.06 |
| HC P291R | 8.38 | 8.45 | 8.50 | 0.06 |
| HC E293K | 8.38 | 8.50 | 8.60 | 0.11 |
| HC E293R | 8.38 | 8.50 | 8.61 | 0.11 |
| HC E294K | 8.38 | 8.50 | 8.60 | 0.11 |
| HC E294R | 8.38 | 8.50 | 8.61 | 0.11 |
| HC Q295K | 8.38 | 8.45 | 8.50 | 0.06 |
| HC Q295R | 8.38 | 8.45 | 8.50 | 0.06 |
| HC Y296K | 8.38 | 8.45 | 8.50 | 0.06 |
| HC Y296R | 8.38 | 8.45 | 8.51 | 0.06 |
| HC N297K | 8.38 | 8.45 | 8.50 | 0.06 |
| HC N297R | 8.38 | 8.45 | 8.50 | 0.06 |
| HC S298K | 8.38 | 8.45 | 8.50 | 0.06 |
| HC S298R | 8.38 | 8.45 | 8.50 | 0.06 |
| HC T307K | 8.38 | 8.45 | 8.50 | 0.06 |
| HC T307R | 8.38 | 8.45 | 8.50 | 0.06 |
| HC L309K | 8.38 | 8.45 | 8.50 | 0.06 |
| HC L309R | 8.38 | 8.45 | 8.50 | 0.06 |
| HC H310K | 8.38 | 8.44 | 8.50 | 0.06 |
| HC H310R | 8.38 | 8.45 | 8.50 | 0.06 |

Figure 46 (cont.)

| Variant | Neutral or Acidic to Basic | | | |
|---|---|---|---|---|
| | IgG1 / IgG1 | pI / IgG1 | pI / pI | delta pI |
| HC Q311K | 8.38 | 8.45 | 8.50 | 0.06 |
| HC Q311R | 8.38 | 8.45 | 8.50 | 0.06 |
| HC L314K | 8.38 | 8.45 | 8.50 | 0.06 |
| HC L314R | 8.38 | 8.45 | 8.50 | 0.06 |
| HC N315K | 8.38 | 8.45 | 8.50 | 0.06 |
| HC N315R | 8.38 | 8.45 | 8.50 | 0.06 |
| HC G316K | 8.38 | 8.45 | 8.50 | 0.06 |
| HC G316R | 8.38 | 8.45 | 8.50 | 0.06 |
| HC E318K | 8.38 | 8.50 | 8.60 | 0.11 |
| HC E318R | 8.38 | 8.50 | 8.61 | 0.11 |
| HC S324K | 8.38 | 8.45 | 8.50 | 0.06 |
| HC S324R | 8.38 | 8.45 | 8.50 | 0.06 |
| HC P329K | 8.38 | 8.45 | 8.50 | 0.06 |
| HC P329R | 8.38 | 8.45 | 8.50 | 0.06 |
| HC A330K | 8.38 | 8.45 | 8.50 | 0.06 |
| HC A330R | 8.38 | 8.45 | 8.50 | 0.06 |
| HC P331K | 8.38 | 8.45 | 8.50 | 0.06 |
| HC P331R | 8.38 | 8.45 | 8.50 | 0.06 |
| HC I332K | 8.38 | 8.45 | 8.50 | 0.06 |
| HC I332R | 8.38 | 8.45 | 8.50 | 0.06 |
| HC E333K | 8.38 | 8.50 | 8.60 | 0.11 |
| HC E333R | 8.38 | 8.50 | 8.61 | 0.11 |
| HC T335K | 8.38 | 8.45 | 8.50 | 0.06 |
| HC T335R | 8.38 | 8.45 | 8.50 | 0.06 |
| HC S337K | 8.38 | 8.45 | 8.50 | 0.06 |
| HC S337R | 8.38 | 8.45 | 8.50 | 0.06 |
| HC A339K | 8.38 | 8.45 | 8.50 | 0.06 |
| HC A339R | 8.38 | 8.45 | 8.50 | 0.06 |
| HC G341K | 8.38 | 8.45 | 8.50 | 0.06 |
| HC G341R | 8.38 | 8.45 | 8.50 | 0.06 |
| HC Q342K | 8.38 | 8.45 | 8.50 | 0.06 |
| HC Q342R | 8.38 | 8.45 | 8.50 | 0.06 |
| HC P343K | 8.38 | 8.45 | 8.50 | 0.06 |
| HC P343R | 8.38 | 8.45 | 8.50 | 0.06 |
| HC E345K | 8.38 | 8.50 | 8.60 | 0.11 |
| HC E345R | 8.38 | 8.50 | 8.61 | 0.11 |
| HC Q347K | 8.38 | 8.45 | 8.50 | 0.06 |
| HC Q347R | 8.38 | 8.45 | 8.50 | 0.06 |
| HC P352K | 8.38 | 8.45 | 8.50 | 0.06 |
| HC P352R | 8.38 | 8.45 | 8.50 | 0.06 |
| HC D356K | 8.38 | 8.50 | 8.60 | 0.11 |
| HC D356R | 8.38 | 8.50 | 8.61 | 0.11 |
| HC L358K | 8.38 | 8.45 | 8.50 | 0.06 |
| HC L358R | 8.38 | 8.45 | 8.50 | 0.06 |
| HC T359K | 8.38 | 8.45 | 8.50 | 0.06 |
| HC T359R | 8.38 | 8.45 | 8.50 | 0.06 |
| HC N361K | 8.38 | 8.45 | 8.50 | 0.06 |
| HC N361R | 8.38 | 8.45 | 8.50 | 0.06 |
| HC Q362K | 8.38 | 8.45 | 8.50 | 0.06 |
| HC Q362R | 8.38 | 8.45 | 8.50 | 0.06 |
| HC Y373K | 8.38 | 8.45 | 8.50 | 0.06 |

Figure 46 (cont.)

| Variant | Neutral or Acidic to Basic | | | |
|---|---|---|---|---|
| | IgG1 / IgG1 | pI / IgG1 | pI / pI | delta pI |
| HC Y373R | 8.38 | 8.45 | 8.51 | 0.06 |
| HC S375K | 8.38 | 8.45 | 8.50 | 0.06 |
| HC S375R | 8.38 | 8.45 | 8.50 | 0.06 |
| HC D376K | 8.38 | 8.50 | 8.60 | 0.11 |
| HC D376R | 8.38 | 8.50 | 8.61 | 0.11 |
| HC E380K | 8.38 | 8.50 | 8.60 | 0.11 |
| HC E380R | 8.38 | 8.50 | 8.61 | 0.11 |
| HC E382K | 8.38 | 8.50 | 8.60 | 0.11 |
| HC E382R | 8.38 | 8.50 | 8.61 | 0.11 |
| HC N384K | 8.38 | 8.45 | 8.50 | 0.06 |
| HC N384R | 8.38 | 8.45 | 8.50 | 0.06 |
| HC G385K | 8.38 | 8.45 | 8.50 | 0.06 |
| HC G385R | 8.38 | 8.45 | 8.50 | 0.06 |
| HC Q386K | 8.38 | 8.45 | 8.50 | 0.06 |
| HC Q386R | 8.38 | 8.45 | 8.50 | 0.06 |
| HC P387K | 8.38 | 8.45 | 8.50 | 0.06 |
| HC P387R | 8.38 | 8.45 | 8.50 | 0.06 |
| HC N389K | 8.38 | 8.45 | 8.50 | 0.06 |
| HC N389R | 8.38 | 8.45 | 8.50 | 0.06 |
| HC N390K | 8.38 | 8.45 | 8.50 | 0.06 |
| HC N390R | 8.38 | 8.45 | 8.50 | 0.06 |
| HC Y391K | 8.38 | 8.45 | 8.50 | 0.06 |
| HC Y391R | 8.38 | 8.45 | 8.51 | 0.06 |
| HC T393K | 8.38 | 8.45 | 8.50 | 0.06 |
| HC T393R | 8.38 | 8.45 | 8.50 | 0.06 |
| HC P395K | 8.38 | 8.45 | 8.50 | 0.06 |
| HC P395R | 8.38 | 8.45 | 8.50 | 0.06 |
| HC P396K | 8.38 | 8.45 | 8.50 | 0.06 |
| HC P396R | 8.38 | 8.45 | 8.50 | 0.06 |
| HC L398K | 8.38 | 8.45 | 8.50 | 0.06 |
| HC L398R | 8.38 | 8.45 | 8.50 | 0.06 |
| HC S400K | 8.38 | 8.45 | 8.50 | 0.06 |
| HC S400R | 8.38 | 8.45 | 8.50 | 0.06 |
| HC D401K | 8.38 | 8.50 | 8.60 | 0.11 |
| HC D401R | 8.38 | 8.50 | 8.61 | 0.11 |
| HC G402K | 8.38 | 8.45 | 8.50 | 0.06 |
| HC G402R | 8.38 | 8.45 | 8.50 | 0.06 |
| HC D413K | 8.38 | 8.50 | 8.60 | 0.11 |
| HC D413R | 8.38 | 8.50 | 8.61 | 0.11 |
| HC S415K | 8.38 | 8.45 | 8.50 | 0.06 |
| HC S415R | 8.38 | 8.45 | 8.50 | 0.06 |
| HC Q418K | 8.38 | 8.45 | 8.50 | 0.06 |
| HC Q418R | 8.38 | 8.45 | 8.50 | 0.06 |
| HC Q419K | 8.38 | 8.45 | 8.50 | 0.06 |
| HC Q419R | 8.38 | 8.45 | 8.50 | 0.06 |
| HC G420K | 8.38 | 8.45 | 8.50 | 0.06 |
| HC G420R | 8.38 | 8.45 | 8.50 | 0.06 |
| HC N421K | 8.38 | 8.45 | 8.50 | 0.06 |
| HC N421R | 8.38 | 8.45 | 8.50 | 0.06 |
| HC V422K | 8.38 | 8.45 | 8.50 | 0.06 |
| HC V422R | 8.38 | 8.45 | 8.50 | 0.06 |

Figure 46 (cont.)

| Variant | Neutral or Acidic to Basic | | | |
|---|---|---|---|---|
| | IgG1 / IgG1 | pI / IgG1 | pI / pI | delta pI |
| HC E430K | 8.38 | 8.50 | 8.60 | 0.11 |
| HC E430R | 8.38 | 8.50 | 8.61 | 0.11 |
| HC A431K | 8.38 | 8.45 | 8.50 | 0.06 |
| HC A431R | 8.38 | 8.45 | 8.50 | 0.06 |
| HC H433K | 8.38 | 8.44 | 8.50 | 0.06 |
| HC H433R | 8.38 | 8.45 | 8.50 | 0.06 |
| HC N434K | 8.38 | 8.45 | 8.50 | 0.06 |
| HC N434R | 8.38 | 8.45 | 8.50 | 0.06 |
| HC H435K | 8.38 | 8.44 | 8.50 | 0.06 |
| HC H435R | 8.38 | 8.45 | 8.50 | 0.06 |
| HC Y436K | 8.38 | 8.45 | 8.50 | 0.06 |
| HC Y436R | 8.38 | 8.45 | 8.51 | 0.06 |
| HC T437K | 8.38 | 8.45 | 8.50 | 0.06 |
| HC T437R | 8.38 | 8.45 | 8.50 | 0.06 |
| HC Q438K | 8.38 | 8.45 | 8.50 | 0.06 |
| HC Q438R | 8.38 | 8.45 | 8.50 | 0.06 |
| HC S440K | 8.38 | 8.45 | 8.50 | 0.06 |
| HC S440R | 8.38 | 8.45 | 8.50 | 0.06 |
| HC S442K | 8.38 | 8.45 | 8.50 | 0.06 |
| HC S442R | 8.38 | 8.45 | 8.50 | 0.06 |
| HC L443K | 8.38 | 8.45 | 8.50 | 0.06 |
| HC L443R | 8.38 | 8.45 | 8.50 | 0.06 |
| HC S444K | 8.38 | 8.45 | 8.50 | 0.06 |
| HC S444R | 8.38 | 8.45 | 8.50 | 0.06 |
| HC P445K | 8.38 | 8.45 | 8.50 | 0.06 |
| HC P445R | 8.38 | 8.45 | 8.50 | 0.06 |
| HC G446K | 8.38 | 8.45 | 8.50 | 0.06 |
| HC G446R | 8.38 | 8.45 | 8.50 | 0.06 |

Figure 47

| Variant | Acidic to Neutral | | | |
|---|---|---|---|---|
| | IgG1 / IgG1 | pI / IgG1 | pI / pI | delta pI |
| HC D148A | 8.38 | 8.45 | 8.50 | 0.06 |
| HC D148F | 8.38 | 8.45 | 8.50 | 0.06 |
| HC D148G | 8.38 | 8.45 | 8.50 | 0.06 |
| HC D148H | 8.38 | 8.45 | 8.50 | 0.06 |
| HC D148I | 8.38 | 8.45 | 8.50 | 0.06 |
| HC D148L | 8.38 | 8.45 | 8.50 | 0.06 |
| HC D148M | 8.38 | 8.45 | 8.50 | 0.06 |
| HC D148N | 8.38 | 8.45 | 8.50 | 0.06 |
| HC D148P | 8.38 | 8.45 | 8.50 | 0.06 |
| HC D148Q | 8.38 | 8.45 | 8.50 | 0.06 |
| HC D148S | 8.38 | 8.45 | 8.50 | 0.06 |
| HC D148T | 8.38 | 8.45 | 8.50 | 0.06 |
| HC D148V | 8.38 | 8.45 | 8.50 | 0.06 |
| HC D148W | 8.38 | 8.45 | 8.50 | 0.06 |
| HC D148Y | 8.38 | 8.45 | 8.50 | 0.06 |
| HC E152A | 8.38 | 8.45 | 8.50 | 0.06 |
| HC E152F | 8.38 | 8.45 | 8.50 | 0.06 |
| HC E152G | 8.38 | 8.45 | 8.50 | 0.06 |
| HC E152H | 8.38 | 8.45 | 8.50 | 0.06 |
| HC E152I | 8.38 | 8.45 | 8.50 | 0.06 |
| HC E152L | 8.38 | 8.45 | 8.50 | 0.06 |
| HC E152M | 8.38 | 8.45 | 8.50 | 0.06 |
| HC E152N | 8.38 | 8.45 | 8.50 | 0.06 |
| HC E152P | 8.38 | 8.45 | 8.50 | 0.06 |
| HC E152Q | 8.38 | 8.45 | 8.50 | 0.06 |
| HC E152S | 8.38 | 8.45 | 8.50 | 0.06 |
| HC E152T | 8.38 | 8.45 | 8.50 | 0.06 |
| HC E152V | 8.38 | 8.45 | 8.50 | 0.06 |
| HC E152W | 8.38 | 8.45 | 8.50 | 0.06 |
| HC E152Y | 8.38 | 8.45 | 8.50 | 0.06 |
| HC D212A | 8.38 | 8.45 | 8.50 | 0.06 |
| HC D212F | 8.38 | 8.45 | 8.50 | 0.06 |
| HC D212G | 8.38 | 8.45 | 8.50 | 0.06 |
| HC D212H | 8.38 | 8.45 | 8.50 | 0.06 |
| HC D212I | 8.38 | 8.45 | 8.50 | 0.06 |
| HC D212L | 8.38 | 8.45 | 8.50 | 0.06 |
| HC D212M | 8.38 | 8.45 | 8.50 | 0.06 |
| HC D212N | 8.38 | 8.45 | 8.50 | 0.06 |
| HC D212P | 8.38 | 8.45 | 8.50 | 0.06 |
| HC D212Q | 8.38 | 8.45 | 8.50 | 0.06 |
| HC D212S | 8.38 | 8.45 | 8.50 | 0.06 |
| HC D212T | 8.38 | 8.45 | 8.50 | 0.06 |
| HC D212V | 8.38 | 8.45 | 8.50 | 0.06 |
| HC D212W | 8.38 | 8.45 | 8.50 | 0.06 |
| HC D212Y | 8.38 | 8.45 | 8.50 | 0.06 |
| HC E216A | 8.38 | 8.45 | 8.50 | 0.06 |
| HC E216F | 8.38 | 8.45 | 8.50 | 0.06 |
| HC E216G | 8.38 | 8.45 | 8.50 | 0.06 |
| HC E216H | 8.38 | 8.45 | 8.50 | 0.06 |

Figure 47 (cont.)

| Variant | Acidic to Neutral | | | |
|---|---|---|---|---|
| | IgG1 / IgG1 | pI / IgG1 | pI / pI | delta pI |
| HC E216I | 8.38 | 8.45 | 8.50 | 0.06 |
| HC E216L | 8.38 | 8.45 | 8.50 | 0.06 |
| HC E216M | 8.38 | 8.45 | 8.50 | 0.06 |
| HC E216N | 8.38 | 8.45 | 8.50 | 0.06 |
| HC E216P | 8.38 | 8.45 | 8.50 | 0.06 |
| HC E216Q | 8.38 | 8.45 | 8.50 | 0.06 |
| HC E216S | 8.38 | 8.45 | 8.50 | 0.06 |
| HC E216T | 8.38 | 8.45 | 8.50 | 0.06 |
| HC E216V | 8.38 | 8.45 | 8.50 | 0.06 |
| HC E216W | 8.38 | 8.45 | 8.50 | 0.06 |
| HC E216Y | 8.38 | 8.45 | 8.50 | 0.06 |
| HC D221A | 8.38 | 8.45 | 8.50 | 0.06 |
| HC D221F | 8.38 | 8.45 | 8.50 | 0.06 |
| HC D221G | 8.38 | 8.45 | 8.50 | 0.06 |
| HC D221H | 8.38 | 8.45 | 8.50 | 0.06 |
| HC D221I | 8.38 | 8.45 | 8.50 | 0.06 |
| HC D221L | 8.38 | 8.45 | 8.50 | 0.06 |
| HC D221M | 8.38 | 8.45 | 8.50 | 0.06 |
| HC D221N | 8.38 | 8.45 | 8.50 | 0.06 |
| HC D221P | 8.38 | 8.45 | 8.50 | 0.06 |
| HC D221Q | 8.38 | 8.45 | 8.50 | 0.06 |
| HC D221S | 8.38 | 8.45 | 8.50 | 0.06 |
| HC D221T | 8.38 | 8.45 | 8.50 | 0.06 |
| HC D221V | 8.38 | 8.45 | 8.50 | 0.06 |
| HC D221W | 8.38 | 8.45 | 8.50 | 0.06 |
| HC D221Y | 8.38 | 8.45 | 8.50 | 0.06 |
| HC E233A | 8.38 | 8.45 | 8.50 | 0.06 |
| HC E233F | 8.38 | 8.45 | 8.50 | 0.06 |
| HC E233G | 8.38 | 8.45 | 8.50 | 0.06 |
| HC E233H | 8.38 | 8.45 | 8.50 | 0.06 |
| HC E233I | 8.38 | 8.45 | 8.50 | 0.06 |
| HC E233L | 8.38 | 8.45 | 8.50 | 0.06 |
| HC E233M | 8.38 | 8.45 | 8.50 | 0.06 |
| HC E233N | 8.38 | 8.45 | 8.50 | 0.06 |
| HC E233P | 8.38 | 8.45 | 8.50 | 0.06 |
| HC E233Q | 8.38 | 8.45 | 8.50 | 0.06 |
| HC E233S | 8.38 | 8.45 | 8.50 | 0.06 |
| HC E233T | 8.38 | 8.45 | 8.50 | 0.06 |
| HC E233V | 8.38 | 8.45 | 8.50 | 0.06 |
| HC E233W | 8.38 | 8.45 | 8.50 | 0.06 |
| HC E233Y | 8.38 | 8.45 | 8.50 | 0.06 |
| HC E258A | 8.38 | 8.45 | 8.50 | 0.06 |
| HC E258F | 8.38 | 8.45 | 8.50 | 0.06 |
| HC E258G | 8.38 | 8.45 | 8.50 | 0.06 |
| HC E258H | 8.38 | 8.45 | 8.50 | 0.06 |
| HC E258I | 8.38 | 8.45 | 8.50 | 0.06 |
| HC E258L | 8.38 | 8.45 | 8.50 | 0.06 |
| HC E258M | 8.38 | 8.45 | 8.50 | 0.06 |
| HC E258N | 8.38 | 8.45 | 8.50 | 0.06 |
| HC E258P | 8.38 | 8.45 | 8.50 | 0.06 |
| HC E258Q | 8.38 | 8.45 | 8.50 | 0.06 |

Figure 47 (cont.)

| Variant | Acidic to Neutral | | | |
|---|---|---|---|---|
| | IgG1 / IgG1 | pI / IgG1 | pI / pI | delta pI |
| HC E258S | 8.38 | 8.45 | 8.50 | 0.06 |
| HC E258T | 8.38 | 8.45 | 8.50 | 0.06 |
| HC E258V | 8.38 | 8.45 | 8.50 | 0.06 |
| HC E258W | 8.38 | 8.45 | 8.50 | 0.06 |
| HC E258Y | 8.38 | 8.45 | 8.50 | 0.06 |
| HC D265A | 8.38 | 8.45 | 8.50 | 0.06 |
| HC D265F | 8.38 | 8.45 | 8.50 | 0.06 |
| HC D265G | 8.38 | 8.45 | 8.50 | 0.06 |
| HC D265H | 8.38 | 8.45 | 8.50 | 0.06 |
| HC D265I | 8.38 | 8.45 | 8.50 | 0.06 |
| HC D265L | 8.38 | 8.45 | 8.50 | 0.06 |
| HC D265M | 8.38 | 8.45 | 8.50 | 0.06 |
| HC D265N | 8.38 | 8.45 | 8.50 | 0.06 |
| HC D265P | 8.38 | 8.45 | 8.50 | 0.06 |
| HC D265Q | 8.38 | 8.45 | 8.50 | 0.06 |
| HC D265S | 8.38 | 8.45 | 8.50 | 0.06 |
| HC D265T | 8.38 | 8.45 | 8.50 | 0.06 |
| HC D265V | 8.38 | 8.45 | 8.50 | 0.06 |
| HC D265W | 8.38 | 8.45 | 8.50 | 0.06 |
| HC D265Y | 8.38 | 8.45 | 8.50 | 0.06 |
| HC E269A | 8.38 | 8.45 | 8.50 | 0.06 |
| HC E269F | 8.38 | 8.45 | 8.50 | 0.06 |
| HC E269G | 8.38 | 8.45 | 8.50 | 0.06 |
| HC E269H | 8.38 | 8.45 | 8.50 | 0.06 |
| HC E269I | 8.38 | 8.45 | 8.50 | 0.06 |
| HC E269L | 8.38 | 8.45 | 8.50 | 0.06 |
| HC E269M | 8.38 | 8.45 | 8.50 | 0.06 |
| HC E269N | 8.38 | 8.45 | 8.50 | 0.06 |
| HC E269P | 8.38 | 8.45 | 8.50 | 0.06 |
| HC E269Q | 8.38 | 8.45 | 8.50 | 0.06 |
| HC E269S | 8.38 | 8.45 | 8.50 | 0.06 |
| HC E269T | 8.38 | 8.45 | 8.50 | 0.06 |
| HC E269V | 8.38 | 8.45 | 8.50 | 0.06 |
| HC E269W | 8.38 | 8.45 | 8.50 | 0.06 |
| HC E269Y | 8.38 | 8.45 | 8.50 | 0.06 |
| HC E272A | 8.38 | 8.45 | 8.50 | 0.06 |
| HC E272F | 8.38 | 8.45 | 8.50 | 0.06 |
| HC E272G | 8.38 | 8.45 | 8.50 | 0.06 |
| HC E272H | 8.38 | 8.45 | 8.50 | 0.06 |
| HC E272I | 8.38 | 8.45 | 8.50 | 0.06 |
| HC E272L | 8.38 | 8.45 | 8.50 | 0.06 |
| HC E272M | 8.38 | 8.45 | 8.50 | 0.06 |
| HC E272N | 8.38 | 8.45 | 8.50 | 0.06 |
| HC E272P | 8.38 | 8.45 | 8.50 | 0.06 |
| HC E272Q | 8.38 | 8.45 | 8.50 | 0.06 |
| HC E272S | 8.38 | 8.45 | 8.50 | 0.06 |
| HC E272T | 8.38 | 8.45 | 8.50 | 0.06 |
| HC E272V | 8.38 | 8.45 | 8.50 | 0.06 |
| HC E272W | 8.38 | 8.45 | 8.50 | 0.06 |
| HC E272Y | 8.38 | 8.45 | 8.50 | 0.06 |
| HC D280A | 8.38 | 8.45 | 8.50 | 0.06 |

Figure 47 (cont.)

| Variant | Acidic to Neutral | | | |
| --- | --- | --- | --- | --- |
| | IgG1 / IgG1 | pI / IgG1 | pI / pI | delta pI |
| HC D280F | 8.38 | 8.45 | 8.50 | 0.06 |
| HC D280G | 8.38 | 8.45 | 8.50 | 0.06 |
| HC D280H | 8.38 | 8.45 | 8.50 | 0.06 |
| HC D280I | 8.38 | 8.45 | 8.50 | 0.06 |
| HC D280L | 8.38 | 8.45 | 8.50 | 0.06 |
| HC D280M | 8.38 | 8.45 | 8.50 | 0.06 |
| HC D280N | 8.38 | 8.45 | 8.50 | 0.06 |
| HC D280P | 8.38 | 8.45 | 8.50 | 0.06 |
| HC D280Q | 8.38 | 8.45 | 8.50 | 0.06 |
| HC D280S | 8.38 | 8.45 | 8.50 | 0.06 |
| HC D280T | 8.38 | 8.45 | 8.50 | 0.06 |
| HC D280V | 8.38 | 8.45 | 8.50 | 0.06 |
| HC D280W | 8.38 | 8.45 | 8.50 | 0.06 |
| HC D280Y | 8.38 | 8.45 | 8.50 | 0.06 |
| HC E283A | 8.38 | 8.45 | 8.50 | 0.06 |
| HC E283F | 8.38 | 8.45 | 8.50 | 0.06 |
| HC E283G | 8.38 | 8.45 | 8.50 | 0.06 |
| HC E283H | 8.38 | 8.45 | 8.50 | 0.06 |
| HC E283I | 8.38 | 8.45 | 8.50 | 0.06 |
| HC E283L | 8.38 | 8.45 | 8.50 | 0.06 |
| HC E283M | 8.38 | 8.45 | 8.50 | 0.06 |
| HC E283N | 8.38 | 8.45 | 8.50 | 0.06 |
| HC E283P | 8.38 | 8.45 | 8.50 | 0.06 |
| HC E283Q | 8.38 | 8.45 | 8.50 | 0.06 |
| HC E283S | 8.38 | 8.45 | 8.50 | 0.06 |
| HC E283T | 8.38 | 8.45 | 8.50 | 0.06 |
| HC E283V | 8.38 | 8.45 | 8.50 | 0.06 |
| HC E283W | 8.38 | 8.45 | 8.50 | 0.06 |
| HC E283Y | 8.38 | 8.45 | 8.50 | 0.06 |
| HC E293A | 8.38 | 8.45 | 8.50 | 0.06 |
| HC E293F | 8.38 | 8.45 | 8.50 | 0.06 |
| HC E293G | 8.38 | 8.45 | 8.50 | 0.06 |
| HC E293H | 8.38 | 8.45 | 8.50 | 0.06 |
| HC E293I | 8.38 | 8.45 | 8.50 | 0.06 |
| HC E293L | 8.38 | 8.45 | 8.50 | 0.06 |
| HC E293M | 8.38 | 8.45 | 8.50 | 0.06 |
| HC E293N | 8.38 | 8.45 | 8.50 | 0.06 |
| HC E293P | 8.38 | 8.45 | 8.50 | 0.06 |
| HC E293Q | 8.38 | 8.45 | 8.50 | 0.06 |
| HC E293S | 8.38 | 8.45 | 8.50 | 0.06 |
| HC E293T | 8.38 | 8.45 | 8.50 | 0.06 |
| HC E293V | 8.38 | 8.45 | 8.50 | 0.06 |
| HC E293W | 8.38 | 8.45 | 8.50 | 0.06 |
| HC E293Y | 8.38 | 8.45 | 8.50 | 0.06 |
| HC E294A | 8.38 | 8.45 | 8.50 | 0.06 |
| HC E294F | 8.38 | 8.45 | 8.50 | 0.06 |
| HC E294G | 8.38 | 8.45 | 8.50 | 0.06 |
| HC E294H | 8.38 | 8.45 | 8.50 | 0.06 |
| HC E294I | 8.38 | 8.45 | 8.50 | 0.06 |
| HC E294L | 8.38 | 8.45 | 8.50 | 0.06 |
| HC E294M | 8.38 | 8.45 | 8.50 | 0.06 |

Figure 47 (cont.)

| Variant | Acidic to Neutral | | | |
| --- | --- | --- | --- | --- |
| | IgG1 / IgG1 | pI / IgG1 | pI / pI | delta pI |
| HC E294N | 8.38 | 8.45 | 8.50 | 0.06 |
| HC E294P | 8.38 | 8.45 | 8.50 | 0.06 |
| HC E294Q | 8.38 | 8.45 | 8.50 | 0.06 |
| HC E294S | 8.38 | 8.45 | 8.50 | 0.06 |
| HC E294T | 8.38 | 8.45 | 8.50 | 0.06 |
| HC E294V | 8.38 | 8.45 | 8.50 | 0.06 |
| HC E294W | 8.38 | 8.45 | 8.50 | 0.06 |
| HC E294Y | 8.38 | 8.45 | 8.50 | 0.06 |
| HC E318A | 8.38 | 8.45 | 8.50 | 0.06 |
| HC E318F | 8.38 | 8.45 | 8.50 | 0.06 |
| HC E318G | 8.38 | 8.45 | 8.50 | 0.06 |
| HC E318H | 8.38 | 8.45 | 8.50 | 0.06 |
| HC E318I | 8.38 | 8.45 | 8.50 | 0.06 |
| HC E318L | 8.38 | 8.45 | 8.50 | 0.06 |
| HC E318M | 8.38 | 8.45 | 8.50 | 0.06 |
| HC E318N | 8.38 | 8.45 | 8.50 | 0.06 |
| HC E318P | 8.38 | 8.45 | 8.50 | 0.06 |
| HC E318Q | 8.38 | 8.45 | 8.50 | 0.06 |
| HC E318S | 8.38 | 8.45 | 8.50 | 0.06 |
| HC E318T | 8.38 | 8.45 | 8.50 | 0.06 |
| HC E318V | 8.38 | 8.45 | 8.50 | 0.06 |
| HC E318W | 8.38 | 8.45 | 8.50 | 0.06 |
| HC E318Y | 8.38 | 8.45 | 8.50 | 0.06 |
| HC E333A | 8.38 | 8.45 | 8.50 | 0.06 |
| HC E333F | 8.38 | 8.45 | 8.50 | 0.06 |
| HC E333G | 8.38 | 8.45 | 8.50 | 0.06 |
| HC E333H | 8.38 | 8.45 | 8.50 | 0.06 |
| HC E333I | 8.38 | 8.45 | 8.50 | 0.06 |
| HC E333L | 8.38 | 8.45 | 8.50 | 0.06 |
| HC E333M | 8.38 | 8.45 | 8.50 | 0.06 |
| HC E333N | 8.38 | 8.45 | 8.50 | 0.06 |
| HC E333P | 8.38 | 8.45 | 8.50 | 0.06 |
| HC E333Q | 8.38 | 8.45 | 8.50 | 0.06 |
| HC E333S | 8.38 | 8.45 | 8.50 | 0.06 |
| HC E333T | 8.38 | 8.45 | 8.50 | 0.06 |
| HC E333V | 8.38 | 8.45 | 8.50 | 0.06 |
| HC E333W | 8.38 | 8.45 | 8.50 | 0.06 |
| HC E333Y | 8.38 | 8.45 | 8.50 | 0.06 |
| HC E345A | 8.38 | 8.45 | 8.50 | 0.06 |
| HC E345F | 8.38 | 8.45 | 8.50 | 0.06 |
| HC E345G | 8.38 | 8.45 | 8.50 | 0.06 |
| HC E345H | 8.38 | 8.45 | 8.50 | 0.06 |
| HC E345I | 8.38 | 8.45 | 8.50 | 0.06 |
| HC E345L | 8.38 | 8.45 | 8.50 | 0.06 |
| HC E345M | 8.38 | 8.45 | 8.50 | 0.06 |
| HC E345N | 8.38 | 8.45 | 8.50 | 0.06 |
| HC E345P | 8.38 | 8.45 | 8.50 | 0.06 |
| HC E345Q | 8.38 | 8.45 | 8.50 | 0.06 |
| HC E345S | 8.38 | 8.45 | 8.50 | 0.06 |
| HC E345T | 8.38 | 8.45 | 8.50 | 0.06 |
| HC E345V | 8.38 | 8.45 | 8.50 | 0.06 |

Figure 47 (cont.)

| Variant | Acidic to Neutral | | | |
|---|---|---|---|---|
| | IgG1 / IgG1 | pI / IgG1 | pI / pI | delta pI |
| HC E345W | 8.38 | 8.45 | 8.50 | 0.06 |
| HC E345Y | 8.38 | 8.45 | 8.50 | 0.06 |
| HC D356A | 8.38 | 8.45 | 8.50 | 0.06 |
| HC D356F | 8.38 | 8.45 | 8.50 | 0.06 |
| HC D356G | 8.38 | 8.45 | 8.50 | 0.06 |
| HC D356H | 8.38 | 8.45 | 8.50 | 0.06 |
| HC D356I | 8.38 | 8.45 | 8.50 | 0.06 |
| HC D356L | 8.38 | 8.45 | 8.50 | 0.06 |
| HC D356M | 8.38 | 8.45 | 8.50 | 0.06 |
| HC D356N | 8.38 | 8.45 | 8.50 | 0.06 |
| HC D356P | 8.38 | 8.45 | 8.50 | 0.06 |
| HC D356Q | 8.38 | 8.45 | 8.50 | 0.06 |
| HC D356S | 8.38 | 8.45 | 8.50 | 0.06 |
| HC D356T | 8.38 | 8.45 | 8.50 | 0.06 |
| HC D356V | 8.38 | 8.45 | 8.50 | 0.06 |
| HC D356W | 8.38 | 8.45 | 8.50 | 0.06 |
| HC D356Y | 8.38 | 8.45 | 8.50 | 0.06 |
| HC D376A | 8.38 | 8.45 | 8.50 | 0.06 |
| HC D376F | 8.38 | 8.45 | 8.50 | 0.06 |
| HC D376G | 8.38 | 8.45 | 8.50 | 0.06 |
| HC D376H | 8.38 | 8.45 | 8.50 | 0.06 |
| HC D376I | 8.38 | 8.45 | 8.50 | 0.06 |
| HC D376L | 8.38 | 8.45 | 8.50 | 0.06 |
| HC D376M | 8.38 | 8.45 | 8.50 | 0.06 |
| HC D376N | 8.38 | 8.45 | 8.50 | 0.06 |
| HC D376P | 8.38 | 8.45 | 8.50 | 0.06 |
| HC D376Q | 8.38 | 8.45 | 8.50 | 0.06 |
| HC D376S | 8.38 | 8.45 | 8.50 | 0.06 |
| HC D376T | 8.38 | 8.45 | 8.50 | 0.06 |
| HC D376V | 8.38 | 8.45 | 8.50 | 0.06 |
| HC D376W | 8.38 | 8.45 | 8.50 | 0.06 |
| HC D376Y | 8.38 | 8.45 | 8.50 | 0.06 |
| HC E380A | 8.38 | 8.45 | 8.50 | 0.06 |
| HC E380F | 8.38 | 8.45 | 8.50 | 0.06 |
| HC E380G | 8.38 | 8.45 | 8.50 | 0.06 |
| HC E380H | 8.38 | 8.45 | 8.50 | 0.06 |
| HC E380I | 8.38 | 8.45 | 8.50 | 0.06 |
| HC E380L | 8.38 | 8.45 | 8.50 | 0.06 |
| HC E380M | 8.38 | 8.45 | 8.50 | 0.06 |
| HC E380N | 8.38 | 8.45 | 8.50 | 0.06 |
| HC E380P | 8.38 | 8.45 | 8.50 | 0.06 |
| HC E380Q | 8.38 | 8.45 | 8.50 | 0.06 |
| HC E380S | 8.38 | 8.45 | 8.50 | 0.06 |
| HC E380T | 8.38 | 8.45 | 8.50 | 0.06 |
| HC E380V | 8.38 | 8.45 | 8.50 | 0.06 |
| HC E380W | 8.38 | 8.45 | 8.50 | 0.06 |
| HC E380Y | 8.38 | 8.45 | 8.50 | 0.06 |
| HC E382A | 8.38 | 8.45 | 8.50 | 0.06 |
| HC E382F | 8.38 | 8.45 | 8.50 | 0.06 |
| HC E382G | 8.38 | 8.45 | 8.50 | 0.06 |
| HC E382H | 8.38 | 8.45 | 8.50 | 0.06 |

Figure 47 (cont.)

| Variant | Acidic to Neutral IgG1 / IgG1 | pI / IgG1 | pI / pI | delta pI |
|---|---|---|---|---|
| HC E382I | 8.38 | 8.45 | 8.50 | 0.06 |
| HC E382L | 8.38 | 8.45 | 8.50 | 0.06 |
| HC E382M | 8.38 | 8.45 | 8.50 | 0.06 |
| HC E382N | 8.38 | 8.45 | 8.50 | 0.06 |
| HC E382P | 8.38 | 8.45 | 8.50 | 0.06 |
| HC E382Q | 8.38 | 8.45 | 8.50 | 0.06 |
| HC E382S | 8.38 | 8.45 | 8.50 | 0.06 |
| HC E382T | 8.38 | 8.45 | 8.50 | 0.06 |
| HC E382V | 8.38 | 8.45 | 8.50 | 0.06 |
| HC E382W | 8.38 | 8.45 | 8.50 | 0.06 |
| HC E382Y | 8.38 | 8.45 | 8.50 | 0.06 |
| HC D401A | 8.38 | 8.45 | 8.50 | 0.06 |
| HC D401F | 8.38 | 8.45 | 8.50 | 0.06 |
| HC D401G | 8.38 | 8.45 | 8.50 | 0.06 |
| HC D401H | 8.38 | 8.45 | 8.50 | 0.06 |
| HC D401I | 8.38 | 8.45 | 8.50 | 0.06 |
| HC D401L | 8.38 | 8.45 | 8.50 | 0.06 |
| HC D401M | 8.38 | 8.45 | 8.50 | 0.06 |
| HC D401N | 8.38 | 8.45 | 8.50 | 0.06 |
| HC D401P | 8.38 | 8.45 | 8.50 | 0.06 |
| HC D401Q | 8.38 | 8.45 | 8.50 | 0.06 |
| HC D401S | 8.38 | 8.45 | 8.50 | 0.06 |
| HC D401T | 8.38 | 8.45 | 8.50 | 0.06 |
| HC D401V | 8.38 | 8.45 | 8.50 | 0.06 |
| HC D401W | 8.38 | 8.45 | 8.50 | 0.06 |
| HC D401Y | 8.38 | 8.45 | 8.50 | 0.06 |
| HC D413A | 8.38 | 8.45 | 8.50 | 0.06 |
| HC D413F | 8.38 | 8.45 | 8.50 | 0.06 |
| HC D413G | 8.38 | 8.45 | 8.50 | 0.06 |
| HC D413H | 8.38 | 8.45 | 8.50 | 0.06 |
| HC D413I | 8.38 | 8.45 | 8.50 | 0.06 |
| HC D413L | 8.38 | 8.45 | 8.50 | 0.06 |
| HC D413M | 8.38 | 8.45 | 8.50 | 0.06 |
| HC D413N | 8.38 | 8.45 | 8.50 | 0.06 |
| HC D413P | 8.38 | 8.45 | 8.50 | 0.06 |
| HC D413Q | 8.38 | 8.45 | 8.50 | 0.06 |
| HC D413S | 8.38 | 8.45 | 8.50 | 0.06 |
| HC D413T | 8.38 | 8.45 | 8.50 | 0.06 |
| HC D413V | 8.38 | 8.45 | 8.50 | 0.06 |
| HC D413W | 8.38 | 8.45 | 8.50 | 0.06 |
| HC D413Y | 8.38 | 8.45 | 8.50 | 0.06 |
| HC E430A | 8.38 | 8.45 | 8.50 | 0.06 |
| HC E430F | 8.38 | 8.45 | 8.50 | 0.06 |
| HC E430G | 8.38 | 8.45 | 8.50 | 0.06 |
| HC E430H | 8.38 | 8.45 | 8.50 | 0.06 |
| HC E430I | 8.38 | 8.45 | 8.50 | 0.06 |
| HC E430L | 8.38 | 8.45 | 8.50 | 0.06 |
| HC E430M | 8.38 | 8.45 | 8.50 | 0.06 |
| HC E430N | 8.38 | 8.45 | 8.50 | 0.06 |
| HC E430P | 8.38 | 8.45 | 8.50 | 0.06 |
| HC E430Q | 8.38 | 8.45 | 8.50 | 0.06 |

Figure 47 (cont.)

| Variant | Acidic to Neutral | | | |
| --- | --- | --- | --- | --- |
| | IgG1 / IgG1 | pI / IgG1 | pI / pI | delta pI |
| HC E430S | 8.38 | 8.45 | 8.50 | 0.06 |
| HC E430T | 8.38 | 8.45 | 8.50 | 0.06 |
| HC E430V | 8.38 | 8.45 | 8.50 | 0.06 |
| HC E430W | 8.38 | 8.45 | 8.50 | 0.06 |
| HC E430Y | 8.38 | 8.45 | 8.50 | 0.06 |

Figure 48

| Variant | Neutral or Basic to Acidic | | | |
|---|---|---|---|---|
| | IgG1 / IgG1 | pI / IgG1 | pI / pI | delta pI |
| LC T109D | 8.02 | 7.94 | 7.85 | -0.09 |
| LC T109E | 8.02 | 7.94 | 7.85 | -0.09 |
| LC V110D | 8.02 | 7.94 | 7.85 | -0.09 |
| LC V110E | 8.02 | 7.94 | 7.85 | -0.09 |
| LC A112D | 8.02 | 7.94 | 7.85 | -0.09 |
| LC A112E | 8.02 | 7.94 | 7.85 | -0.09 |
| LC S114D | 8.02 | 7.94 | 7.85 | -0.09 |
| LC S114E | 8.02 | 7.94 | 7.85 | -0.09 |
| LC P119D | 8.02 | 7.94 | 7.85 | -0.09 |
| LC P119E | 8.02 | 7.94 | 7.85 | -0.09 |
| LC K126D | 8.02 | 7.85 | 7.61 | -0.21 |
| LC K126E | 8.02 | 7.85 | 7.61 | -0.21 |
| LC S127D | 8.02 | 7.94 | 7.85 | -0.09 |
| LC S127E | 8.02 | 7.94 | 7.85 | -0.09 |
| LC G128D | 8.02 | 7.94 | 7.85 | -0.09 |
| LC G128E | 8.02 | 7.94 | 7.85 | -0.09 |
| LC T129D | 8.02 | 7.94 | 7.85 | -0.09 |
| LC T129E | 8.02 | 7.94 | 7.85 | -0.09 |
| LC N138D | 8.02 | 7.94 | 7.85 | -0.09 |
| LC N138E | 8.02 | 7.94 | 7.85 | -0.09 |
| LC R142D | 8.02 | 7.85 | 7.61 | -0.21 |
| LC R142E | 8.02 | 7.85 | 7.61 | -0.21 |
| LC K145D | 8.02 | 7.85 | 7.61 | -0.21 |
| LC K145E | 8.02 | 7.85 | 7.61 | -0.21 |
| LC Q147D | 8.02 | 7.94 | 7.85 | -0.09 |
| LC Q147E | 8.02 | 7.94 | 7.85 | -0.09 |
| LC K149D | 8.02 | 7.85 | 7.61 | -0.21 |
| LC K149E | 8.02 | 7.85 | 7.61 | -0.21 |
| LC N152D | 8.02 | 7.94 | 7.85 | -0.09 |
| LC N152E | 8.02 | 7.94 | 7.85 | -0.09 |
| LC A153D | 8.02 | 7.94 | 7.85 | -0.09 |
| LC A153E | 8.02 | 7.94 | 7.85 | -0.09 |
| LC L154D | 8.02 | 7.94 | 7.85 | -0.09 |
| LC L154E | 8.02 | 7.94 | 7.85 | -0.09 |
| LC S156D | 8.02 | 7.94 | 7.85 | -0.09 |
| LC S156E | 8.02 | 7.94 | 7.85 | -0.09 |
| LC G157D | 8.02 | 7.94 | 7.85 | -0.09 |
| LC G157E | 8.02 | 7.94 | 7.85 | -0.09 |
| LC N158D | 8.02 | 7.94 | 7.85 | -0.09 |
| LC N158E | 8.02 | 7.94 | 7.85 | -0.09 |
| LC S159D | 8.02 | 7.94 | 7.85 | -0.09 |
| LC S159E | 8.02 | 7.94 | 7.85 | -0.09 |
| LC Q160D | 8.02 | 7.94 | 7.85 | -0.09 |
| LC Q160E | 8.02 | 7.94 | 7.85 | -0.09 |
| LC S168D | 8.02 | 7.94 | 7.85 | -0.09 |
| LC S168E | 8.02 | 7.94 | 7.85 | -0.09 |
| LC K169D | 8.02 | 7.85 | 7.61 | -0.21 |
| LC K169E | 8.02 | 7.85 | 7.61 | -0.21 |
| LC T180D | 8.02 | 7.94 | 7.85 | -0.09 |

Figure 48 (cont.)

| Variant | Neutral or Basic to Acidic | | | |
|---|---|---|---|---|
| | IgG1 / IgG1 | pI / IgG1 | pI / pI | delta pI |
| LC T180E | 8.02 | 7.94 | 7.85 | -0.09 |
| LC L181D | 8.02 | 7.94 | 7.85 | -0.09 |
| LC L181E | 8.02 | 7.94 | 7.85 | -0.09 |
| LC S182D | 8.02 | 7.94 | 7.85 | -0.09 |
| LC S182E | 8.02 | 7.94 | 7.85 | -0.09 |
| LC K183D | 8.02 | 7.85 | 7.61 | -0.21 |
| LC K183E | 8.02 | 7.85 | 7.61 | -0.21 |
| LC A184D | 8.02 | 7.94 | 7.85 | -0.09 |
| LC A184E | 8.02 | 7.94 | 7.85 | -0.09 |
| LC K188D | 8.02 | 7.85 | 7.61 | -0.21 |
| LC K188E | 8.02 | 7.85 | 7.61 | -0.21 |
| LC H189D | 8.02 | 7.94 | 7.84 | -0.09 |
| LC H189E | 8.02 | 7.94 | 7.84 | -0.09 |
| LC K190D | 8.02 | 7.85 | 7.61 | -0.21 |
| LC K190E | 8.02 | 7.85 | 7.61 | -0.21 |
| LC V191D | 8.02 | 7.94 | 7.85 | -0.09 |
| LC V191E | 8.02 | 7.94 | 7.85 | -0.09 |
| LC T197D | 8.02 | 7.94 | 7.85 | -0.09 |
| LC T197E | 8.02 | 7.94 | 7.85 | -0.09 |
| LC Q199D | 8.02 | 7.94 | 7.85 | -0.09 |
| LC Q199E | 8.02 | 7.94 | 7.85 | -0.09 |
| LC G200D | 8.02 | 7.94 | 7.85 | -0.09 |
| LC G200E | 8.02 | 7.94 | 7.85 | -0.09 |
| LC R202D | 8.02 | 7.94 | 7.85 | -0.09 |
| LC R202E | 8.02 | 7.94 | 7.85 | -0.09 |
| LC S203D | 8.02 | 7.94 | 7.85 | -0.09 |
| LC S203E | 8.02 | 7.94 | 7.85 | -0.09 |
| LC P204D | 8.02 | 7.94 | 7.85 | -0.09 |
| LC P204E | 8.02 | 7.94 | 7.85 | -0.09 |
| LC V205D | 8.02 | 7.94 | 7.85 | -0.09 |
| LC V205E | 8.02 | 7.94 | 7.85 | -0.09 |
| LC T206D | 8.02 | 7.94 | 7.85 | -0.09 |
| LC T206E | 8.02 | 7.94 | 7.85 | -0.09 |
| LC K207D | 8.02 | 7.85 | 7.61 | -0.21 |
| LC K207E | 8.02 | 7.85 | 7.61 | -0.21 |
| LC S208D | 8.02 | 7.94 | 7.85 | -0.09 |
| LC S208E | 8.02 | 7.94 | 7.85 | -0.09 |
| LC N210D | 8.02 | 7.94 | 7.85 | -0.09 |
| LC N210E | 8.02 | 7.94 | 7.85 | -0.09 |
| LC R211D | 8.02 | 7.85 | 7.61 | -0.21 |
| LC R211E | 8.02 | 7.85 | 7.61 | -0.21 |
| LC G212D | 8.02 | 7.94 | 7.85 | -0.09 |
| LC G212E | 8.02 | 7.94 | 7.85 | -0.09 |
| LC C214D | 8.02 | 7.95 | 7.86 | -0.08 |
| LC C214E | 8.02 | 7.95 | 7.86 | -0.08 |

Figure 49

| Variant | Basic to Neutral | | | |
| --- | --- | --- | --- | --- |
| | IgG1 / IgG1 | pI / IgG1 | pI / pI | delta pI |
| LC K126A | 8.02 | 7.94 | 7.85 | -0.09 |
| LC K126F | 8.02 | 7.94 | 7.85 | -0.09 |
| LC K126G | 8.02 | 7.94 | 7.85 | -0.09 |
| LC K126H | 8.02 | 7.94 | 7.85 | -0.09 |
| LC K126I | 8.02 | 7.94 | 7.85 | -0.09 |
| LC K126L | 8.02 | 7.94 | 7.85 | -0.09 |
| LC K126M | 8.02 | 7.94 | 7.85 | -0.09 |
| LC K126N | 8.02 | 7.94 | 7.85 | -0.09 |
| LC K126P | 8.02 | 7.94 | 7.85 | -0.09 |
| LC K126Q | 8.02 | 7.94 | 7.85 | -0.09 |
| LC K126S | 8.02 | 7.94 | 7.85 | -0.09 |
| LC K126T | 8.02 | 7.94 | 7.85 | -0.09 |
| LC K126V | 8.02 | 7.94 | 7.85 | -0.09 |
| LC K126W | 8.02 | 7.94 | 7.85 | -0.09 |
| LC K126Y | 8.02 | 7.94 | 7.85 | -0.09 |
| LC R142A | 8.02 | 7.94 | 7.85 | -0.09 |
| LC R142F | 8.02 | 7.94 | 7.85 | -0.09 |
| LC R142G | 8.02 | 7.94 | 7.85 | -0.09 |
| LC R142H | 8.02 | 7.94 | 7.85 | -0.09 |
| LC R142I | 8.02 | 7.94 | 7.85 | -0.09 |
| LC R142L | 8.02 | 7.94 | 7.85 | -0.09 |
| LC R142M | 8.02 | 7.94 | 7.85 | -0.09 |
| LC R142N | 8.02 | 7.94 | 7.85 | -0.09 |
| LC R142P | 8.02 | 7.94 | 7.85 | -0.09 |
| LC R142Q | 8.02 | 7.94 | 7.85 | -0.09 |
| LC R142S | 8.02 | 7.94 | 7.85 | -0.09 |
| LC R142T | 8.02 | 7.94 | 7.85 | -0.09 |
| LC R142V | 8.02 | 7.94 | 7.85 | -0.09 |
| LC R142W | 8.02 | 7.94 | 7.85 | -0.09 |
| LC R142Y | 8.02 | 7.94 | 7.84 | -0.09 |
| LC K145A | 8.02 | 7.94 | 7.85 | -0.09 |
| LC K145F | 8.02 | 7.94 | 7.85 | -0.09 |
| LC K145G | 8.02 | 7.94 | 7.85 | -0.09 |
| LC K145H | 8.02 | 7.94 | 7.85 | -0.09 |
| LC K145I | 8.02 | 7.94 | 7.85 | -0.09 |
| LC K145L | 8.02 | 7.94 | 7.85 | -0.09 |
| LC K145M | 8.02 | 7.94 | 7.85 | -0.09 |
| LC K145N | 8.02 | 7.94 | 7.85 | -0.09 |
| LC K145P | 8.02 | 7.94 | 7.85 | -0.09 |
| LC K145Q | 8.02 | 7.94 | 7.85 | -0.09 |
| LC K145S | 8.02 | 7.94 | 7.85 | -0.09 |
| LC K145T | 8.02 | 7.94 | 7.85 | -0.09 |
| LC K145V | 8.02 | 7.94 | 7.85 | -0.09 |
| LC K145W | 8.02 | 7.94 | 7.85 | -0.09 |
| LC K145Y | 8.02 | 7.94 | 7.85 | -0.09 |
| LC K149A | 8.02 | 7.94 | 7.85 | -0.09 |
| LC K149F | 8.02 | 7.94 | 7.85 | -0.09 |
| LC K149G | 8.02 | 7.94 | 7.85 | -0.09 |
| LC K149H | 8.02 | 7.94 | 7.85 | -0.09 |

Figure 49 (cont.)

| Variant | Basic to Neutral IgG1 / IgG1 | pI / IgG1 | pI / pI | delta pI |
|---|---|---|---|---|
| LC K149I | 8.02 | 7.94 | 7.85 | -0.09 |
| LC K149L | 8.02 | 7.94 | 7.85 | -0.09 |
| LC K149M | 8.02 | 7.94 | 7.85 | -0.09 |
| LC K149N | 8.02 | 7.94 | 7.85 | -0.09 |
| LC K149P | 8.02 | 7.94 | 7.85 | -0.09 |
| LC K149Q | 8.02 | 7.94 | 7.85 | -0.09 |
| LC K149S | 8.02 | 7.94 | 7.85 | -0.09 |
| LC K149T | 8.02 | 7.94 | 7.85 | -0.09 |
| LC K149V | 8.02 | 7.94 | 7.85 | -0.09 |
| LC K149W | 8.02 | 7.94 | 7.85 | -0.09 |
| LC K149Y | 8.02 | 7.94 | 7.85 | -0.09 |
| LC K169A | 8.02 | 7.94 | 7.85 | -0.09 |
| LC K169F | 8.02 | 7.94 | 7.85 | -0.09 |
| LC K169G | 8.02 | 7.94 | 7.85 | -0.09 |
| LC K169H | 8.02 | 7.94 | 7.85 | -0.09 |
| LC K169I | 8.02 | 7.94 | 7.85 | -0.09 |
| LC K169L | 8.02 | 7.94 | 7.85 | -0.09 |
| LC K169M | 8.02 | 7.94 | 7.85 | -0.09 |
| LC K169N | 8.02 | 7.94 | 7.85 | -0.09 |
| LC K169P | 8.02 | 7.94 | 7.85 | -0.09 |
| LC K169Q | 8.02 | 7.94 | 7.85 | -0.09 |
| LC K169S | 8.02 | 7.94 | 7.85 | -0.09 |
| LC K169T | 8.02 | 7.94 | 7.85 | -0.09 |
| LC K169V | 8.02 | 7.94 | 7.85 | -0.09 |
| LC K169W | 8.02 | 7.94 | 7.85 | -0.09 |
| LC K169Y | 8.02 | 7.94 | 7.85 | -0.09 |
| LC K183A | 8.02 | 7.94 | 7.85 | -0.09 |
| LC K183F | 8.02 | 7.94 | 7.85 | -0.09 |
| LC K183G | 8.02 | 7.94 | 7.85 | -0.09 |
| LC K183H | 8.02 | 7.94 | 7.85 | -0.09 |
| LC K183I | 8.02 | 7.94 | 7.85 | -0.09 |
| LC K183L | 8.02 | 7.94 | 7.85 | -0.09 |
| LC K183M | 8.02 | 7.94 | 7.85 | -0.09 |
| LC K183N | 8.02 | 7.94 | 7.85 | -0.09 |
| LC K183P | 8.02 | 7.94 | 7.85 | -0.09 |
| LC K183Q | 8.02 | 7.94 | 7.85 | -0.09 |
| LC K183S | 8.02 | 7.94 | 7.85 | -0.09 |
| LC K183T | 8.02 | 7.94 | 7.85 | -0.09 |
| LC K183V | 8.02 | 7.94 | 7.85 | -0.09 |
| LC K183W | 8.02 | 7.94 | 7.85 | -0.09 |
| LC K183Y | 8.02 | 7.94 | 7.85 | -0.09 |
| LC K188A | 8.02 | 7.94 | 7.85 | -0.09 |
| LC K188F | 8.02 | 7.94 | 7.85 | -0.09 |
| LC K188G | 8.02 | 7.94 | 7.85 | -0.09 |
| LC K188H | 8.02 | 7.94 | 7.85 | -0.09 |
| LC K188I | 8.02 | 7.94 | 7.85 | -0.09 |
| LC K188L | 8.02 | 7.94 | 7.85 | -0.09 |
| LC K188M | 8.02 | 7.94 | 7.85 | -0.09 |
| LC K188N | 8.02 | 7.94 | 7.85 | -0.09 |
| LC K188P | 8.02 | 7.94 | 7.85 | -0.09 |
| LC K188Q | 8.02 | 7.94 | 7.85 | -0.09 |

Figure 49 (cont.)

| Variant | Basic to Neutral IgG1 / IgG1 | pI / IgG1 | pI / pI | delta pI |
|---|---|---|---|---|
| LC K188S | 8.02 | 7.94 | 7.85 | -0.09 |
| LC K188T | 8.02 | 7.94 | 7.85 | -0.09 |
| LC K188V | 8.02 | 7.94 | 7.85 | -0.09 |
| LC K188W | 8.02 | 7.94 | 7.85 | -0.09 |
| LC K188Y | 8.02 | 7.94 | 7.85 | -0.09 |
| LC K190A | 8.02 | 7.94 | 7.85 | -0.09 |
| LC K190F | 8.02 | 7.94 | 7.85 | -0.09 |
| LC K190G | 8.02 | 7.94 | 7.85 | -0.09 |
| LC K190H | 8.02 | 7.94 | 7.85 | -0.09 |
| LC K190I | 8.02 | 7.94 | 7.85 | -0.09 |
| LC K190L | 8.02 | 7.94 | 7.85 | -0.09 |
| LC K190M | 8.02 | 7.94 | 7.85 | -0.09 |
| LC K190N | 8.02 | 7.94 | 7.85 | -0.09 |
| LC K190P | 8.02 | 7.94 | 7.85 | -0.09 |
| LC K190Q | 8.02 | 7.94 | 7.85 | -0.09 |
| LC K190S | 8.02 | 7.94 | 7.85 | -0.09 |
| LC K190T | 8.02 | 7.94 | 7.85 | -0.09 |
| LC K190V | 8.02 | 7.94 | 7.85 | -0.09 |
| LC K190W | 8.02 | 7.94 | 7.85 | -0.09 |
| LC K190Y | 8.02 | 7.94 | 7.85 | -0.09 |
| LC R202A | 8.02 | 8.02 | 8.02 | 0.00 |
| LC R202F | 8.02 | 8.02 | 8.02 | 0.00 |
| LC R202G | 8.02 | 8.02 | 8.02 | 0.00 |
| LC R202H | 8.02 | 8.02 | 8.02 | 0.00 |
| LC R202I | 8.02 | 8.02 | 8.02 | 0.00 |
| LC R202L | 8.02 | 8.02 | 8.02 | 0.00 |
| LC R202M | 8.02 | 8.02 | 8.02 | 0.00 |
| LC R202N | 8.02 | 8.02 | 8.02 | 0.00 |
| LC R202P | 8.02 | 8.02 | 8.02 | 0.00 |
| LC R202Q | 8.02 | 8.02 | 8.02 | 0.00 |
| LC R202S | 8.02 | 8.02 | 8.02 | 0.00 |
| LC R202T | 8.02 | 8.02 | 8.02 | 0.00 |
| LC R202V | 8.02 | 8.02 | 8.02 | 0.00 |
| LC R202W | 8.02 | 8.02 | 8.02 | 0.00 |
| LC R202Y | 8.02 | 8.02 | 8.02 | 0.00 |
| LC K207A | 8.02 | 7.94 | 7.85 | -0.09 |
| LC K207F | 8.02 | 7.94 | 7.85 | -0.09 |
| LC K207G | 8.02 | 7.94 | 7.85 | -0.09 |
| LC K207H | 8.02 | 7.94 | 7.85 | -0.09 |
| LC K207I | 8.02 | 7.94 | 7.85 | -0.09 |
| LC K207L | 8.02 | 7.94 | 7.85 | -0.09 |
| LC K207M | 8.02 | 7.94 | 7.85 | -0.09 |
| LC K207N | 8.02 | 7.94 | 7.85 | -0.09 |
| LC K207P | 8.02 | 7.94 | 7.85 | -0.09 |
| LC K207Q | 8.02 | 7.94 | 7.85 | -0.09 |
| LC K207S | 8.02 | 7.94 | 7.85 | -0.09 |
| LC K207T | 8.02 | 7.94 | 7.85 | -0.09 |
| LC K207V | 8.02 | 7.94 | 7.85 | -0.09 |
| LC K207W | 8.02 | 7.94 | 7.85 | -0.09 |
| LC K207Y | 8.02 | 7.94 | 7.85 | -0.09 |
| LC R211A | 8.02 | 7.94 | 7.85 | -0.09 |

Figure 49 (cont.)

| Variant | Basic to Neutral | | | |
|---|---|---|---|---|
| | IgG1 / IgG1 | pI / IgG1 | pI / pI | delta pI |
| LC R211F | 8.02 | 7.94 | 7.85 | -0.09 |
| LC R211G | 8.02 | 7.94 | 7.85 | -0.09 |
| LC R211H | 8.02 | 7.94 | 7.85 | -0.09 |
| LC R211I | 8.02 | 7.94 | 7.85 | -0.09 |
| LC R211L | 8.02 | 7.94 | 7.85 | -0.09 |
| LC R211M | 8.02 | 7.94 | 7.85 | -0.09 |
| LC R211N | 8.02 | 7.94 | 7.85 | -0.09 |
| LC R211P | 8.02 | 7.94 | 7.85 | -0.09 |
| LC R211Q | 8.02 | 7.94 | 7.85 | -0.09 |
| LC R211S | 8.02 | 7.94 | 7.85 | -0.09 |
| LC R211T | 8.02 | 7.94 | 7.85 | -0.09 |
| LC R211V | 8.02 | 7.94 | 7.85 | -0.09 |
| LC R211W | 8.02 | 7.94 | 7.85 | -0.09 |
| LC R211Y | 8.02 | 7.94 | 7.84 | -0.09 |

Figure 50

| Neutral or Acidic to Basic | | | | |
|---|---|---|---|---|
| Variant | IgG1 / IgG1 | pI / IgG1 | pI / pI | delta pI |
| LC T109K | 8.02 | 8.10 | 8.16 | 0.07 |
| LC T109R | 8.02 | 8.10 | 8.16 | 0.07 |
| LC V110K | 8.02 | 8.10 | 8.16 | 0.07 |
| LC V110R | 8.02 | 8.10 | 8.16 | 0.07 |
| LC A112K | 8.02 | 8.10 | 8.16 | 0.07 |
| LC A112R | 8.02 | 8.10 | 8.16 | 0.07 |
| LC S114K | 8.02 | 8.10 | 8.16 | 0.07 |
| LC S114R | 8.02 | 8.10 | 8.16 | 0.07 |
| LC P119K | 8.02 | 8.10 | 8.16 | 0.07 |
| LC P119R | 8.02 | 8.10 | 8.16 | 0.07 |
| LC D122K | 8.02 | 8.16 | 8.27 | 0.13 |
| LC D122R | 8.02 | 8.16 | 8.28 | 0.13 |
| LC E123K | 8.02 | 8.16 | 8.27 | 0.13 |
| LC E123R | 8.02 | 8.16 | 8.28 | 0.13 |
| LC S127K | 8.02 | 8.10 | 8.16 | 0.07 |
| LC S127R | 8.02 | 8.10 | 8.16 | 0.07 |
| LC G128K | 8.02 | 8.10 | 8.16 | 0.07 |
| LC G128R | 8.02 | 8.10 | 8.16 | 0.07 |
| LC T129K | 8.02 | 8.10 | 8.16 | 0.07 |
| LC T129R | 8.02 | 8.10 | 8.16 | 0.07 |
| LC N138K | 8.02 | 8.10 | 8.16 | 0.07 |
| LC N138R | 8.02 | 8.10 | 8.16 | 0.07 |
| LC E143K | 8.02 | 8.16 | 8.27 | 0.13 |
| LC E143R | 8.02 | 8.16 | 8.28 | 0.13 |
| LC Q147K | 8.02 | 8.10 | 8.16 | 0.07 |
| LC Q147R | 8.02 | 8.10 | 8.16 | 0.07 |
| LC D151K | 8.02 | 8.16 | 8.27 | 0.13 |
| LC D151R | 8.02 | 8.16 | 8.28 | 0.13 |
| LC N152K | 8.02 | 8.10 | 8.16 | 0.07 |
| LC N152R | 8.02 | 8.10 | 8.16 | 0.07 |
| LC A153K | 8.02 | 8.10 | 8.16 | 0.07 |
| LC A153R | 8.02 | 8.10 | 8.16 | 0.07 |
| LC L154K | 8.02 | 8.10 | 8.16 | 0.07 |
| LC L154R | 8.02 | 8.10 | 8.16 | 0.07 |
| LC S156K | 8.02 | 8.10 | 8.16 | 0.07 |
| LC S156R | 8.02 | 8.10 | 8.16 | 0.07 |
| LC G157K | 8.02 | 8.10 | 8.16 | 0.07 |
| LC G157R | 8.02 | 8.10 | 8.16 | 0.07 |
| LC N158K | 8.02 | 8.10 | 8.16 | 0.07 |
| LC N158R | 8.02 | 8.10 | 8.16 | 0.07 |
| LC S159K | 8.02 | 8.10 | 8.16 | 0.07 |
| LC S159R | 8.02 | 8.10 | 8.16 | 0.07 |
| LC Q160K | 8.02 | 8.10 | 8.16 | 0.07 |
| LC Q160R | 8.02 | 8.10 | 8.16 | 0.07 |
| LC E161K | 8.02 | 8.16 | 8.27 | 0.13 |
| LC E161R | 8.02 | 8.16 | 8.28 | 0.13 |
| LC E165K | 8.02 | 8.16 | 8.27 | 0.13 |
| LC E165R | 8.02 | 8.16 | 8.28 | 0.13 |
| LC D167K | 8.02 | 8.16 | 8.27 | 0.13 |

Figure 50 (cont.)

| Variant | Neutral or Acidic to Basic | | | |
|---|---|---|---|---|
| | IgG1 / IgG1 | pI / IgG1 | pI / pI | delta pI |
| LC D167R | 8.02 | 8.16 | 8.28 | 0.13 |
| LC S168K | 8.02 | 8.10 | 8.16 | 0.07 |
| LC S168R | 8.02 | 8.10 | 8.16 | 0.07 |
| LC D170K | 8.02 | 8.16 | 8.27 | 0.13 |
| LC D170R | 8.02 | 8.16 | 8.28 | 0.13 |
| LC T180K | 8.02 | 8.10 | 8.16 | 0.07 |
| LC T180R | 8.02 | 8.10 | 8.16 | 0.07 |
| LC L181K | 8.02 | 8.10 | 8.16 | 0.07 |
| LC L181R | 8.02 | 8.10 | 8.16 | 0.07 |
| LC S182K | 8.02 | 8.10 | 8.16 | 0.07 |
| LC S182R | 8.02 | 8.10 | 8.16 | 0.07 |
| LC A184K | 8.02 | 8.10 | 8.16 | 0.07 |
| LC A184R | 8.02 | 8.10 | 8.16 | 0.07 |
| LC D185K | 8.02 | 8.16 | 8.27 | 0.13 |
| LC D185R | 8.02 | 8.16 | 8.28 | 0.13 |
| LC E187K | 8.02 | 8.16 | 8.27 | 0.13 |
| LC E187R | 8.02 | 8.16 | 8.28 | 0.13 |
| LC H189K | 8.02 | 8.09 | 8.16 | 0.07 |
| LC H189R | 8.02 | 8.10 | 8.16 | 0.07 |
| LC V191K | 8.02 | 8.10 | 8.16 | 0.07 |
| LC V191R | 8.02 | 8.10 | 8.16 | 0.07 |
| LC T197K | 8.02 | 8.10 | 8.16 | 0.07 |
| LC T197R | 8.02 | 8.10 | 8.16 | 0.07 |
| LC Q199K | 8.02 | 8.10 | 8.16 | 0.07 |
| LC Q199R | 8.02 | 8.10 | 8.16 | 0.07 |
| LC G200K | 8.02 | 8.10 | 8.16 | 0.07 |
| LC G200R | 8.02 | 8.10 | 8.16 | 0.07 |
| LC S203K | 8.02 | 8.10 | 8.16 | 0.07 |
| LC S203R | 8.02 | 8.10 | 8.16 | 0.07 |
| LC P204K | 8.02 | 8.10 | 8.16 | 0.07 |
| LC P204R | 8.02 | 8.10 | 8.16 | 0.07 |
| LC V205K | 8.02 | 8.10 | 8.16 | 0.07 |
| LC V205R | 8.02 | 8.10 | 8.16 | 0.07 |
| LC T206K | 8.02 | 8.10 | 8.16 | 0.07 |
| LC T206R | 8.02 | 8.10 | 8.16 | 0.07 |
| LC S208K | 8.02 | 8.10 | 8.16 | 0.07 |
| LC S208R | 8.02 | 8.10 | 8.16 | 0.07 |
| LC N210K | 8.02 | 8.10 | 8.16 | 0.07 |
| LC N210R | 8.02 | 8.10 | 8.16 | 0.07 |
| LC G212K | 8.02 | 8.10 | 8.16 | 0.07 |
| LC G212R | 8.02 | 8.10 | 8.16 | 0.07 |
| LC E213K | 8.02 | 8.16 | 8.27 | 0.13 |
| LC E213R | 8.02 | 8.16 | 8.28 | 0.13 |
| LC C214K | 8.02 | 8.10 | 8.18 | 0.08 |
| LC C214R | 8.02 | 8.10 | 8.18 | 0.08 |

Figure 51

| Variant | Acidic to Neutral | | | |
| --- | --- | --- | --- | --- |
| | IgG1 / IgG1 | pI / IgG1 | pI / pI | delta pI |
| LC D122A | 8.02 | 8.10 | 8.16 | 0.07 |
| LC D122F | 8.02 | 8.10 | 8.16 | 0.07 |
| LC D122G | 8.02 | 8.10 | 8.16 | 0.07 |
| LC D122H | 8.02 | 8.10 | 8.16 | 0.07 |
| LC D122I | 8.02 | 8.10 | 8.16 | 0.07 |
| LC D122L | 8.02 | 8.10 | 8.16 | 0.07 |
| LC D122M | 8.02 | 8.10 | 8.16 | 0.07 |
| LC D122N | 8.02 | 8.10 | 8.16 | 0.07 |
| LC D122P | 8.02 | 8.10 | 8.16 | 0.07 |
| LC D122Q | 8.02 | 8.10 | 8.16 | 0.07 |
| LC D122S | 8.02 | 8.10 | 8.16 | 0.07 |
| LC D122T | 8.02 | 8.10 | 8.16 | 0.07 |
| LC D122V | 8.02 | 8.10 | 8.16 | 0.07 |
| LC D122W | 8.02 | 8.10 | 8.16 | 0.07 |
| LC D122Y | 8.02 | 8.10 | 8.16 | 0.07 |
| LC E123A | 8.02 | 8.10 | 8.16 | 0.07 |
| LC E123F | 8.02 | 8.10 | 8.16 | 0.07 |
| LC E123G | 8.02 | 8.10 | 8.16 | 0.07 |
| LC E123H | 8.02 | 8.10 | 8.16 | 0.07 |
| LC E123I | 8.02 | 8.10 | 8.16 | 0.07 |
| LC E123L | 8.02 | 8.10 | 8.16 | 0.07 |
| LC E123M | 8.02 | 8.10 | 8.16 | 0.07 |
| LC E123N | 8.02 | 8.10 | 8.16 | 0.07 |
| LC E123P | 8.02 | 8.10 | 8.16 | 0.07 |
| LC E123Q | 8.02 | 8.10 | 8.16 | 0.07 |
| LC E123S | 8.02 | 8.10 | 8.16 | 0.07 |
| LC E123T | 8.02 | 8.10 | 8.16 | 0.07 |
| LC E123V | 8.02 | 8.10 | 8.16 | 0.07 |
| LC E123W | 8.02 | 8.10 | 8.16 | 0.07 |
| LC E123Y | 8.02 | 8.10 | 8.16 | 0.07 |
| LC E143A | 8.02 | 8.10 | 8.16 | 0.07 |
| LC E143F | 8.02 | 8.10 | 8.16 | 0.07 |
| LC E143G | 8.02 | 8.10 | 8.16 | 0.07 |
| LC E143H | 8.02 | 8.10 | 8.16 | 0.07 |
| LC E143I | 8.02 | 8.10 | 8.16 | 0.07 |
| LC E143L | 8.02 | 8.10 | 8.16 | 0.07 |
| LC E143M | 8.02 | 8.10 | 8.16 | 0.07 |
| LC E143N | 8.02 | 8.10 | 8.16 | 0.07 |
| LC E143P | 8.02 | 8.10 | 8.16 | 0.07 |
| LC E143Q | 8.02 | 8.10 | 8.16 | 0.07 |
| LC E143S | 8.02 | 8.10 | 8.16 | 0.07 |
| LC E143T | 8.02 | 8.10 | 8.16 | 0.07 |
| LC E143V | 8.02 | 8.10 | 8.16 | 0.07 |
| LC E143W | 8.02 | 8.10 | 8.16 | 0.07 |
| LC E143Y | 8.02 | 8.10 | 8.16 | 0.07 |
| LC D151A | 8.02 | 8.10 | 8.16 | 0.07 |
| LC D151F | 8.02 | 8.10 | 8.16 | 0.07 |
| LC D151G | 8.02 | 8.10 | 8.16 | 0.07 |
| LC D151H | 8.02 | 8.10 | 8.16 | 0.07 |

Figure 51 (cont.)

| Variant | Acidic to Neutral IgG1 / IgG1 | pI / IgG1 | pI / pI | delta pI |
|---|---|---|---|---|
| LC D151I | 8.02 | 8.10 | 8.16 | 0.07 |
| LC D151L | 8.02 | 8.10 | 8.16 | 0.07 |
| LC D151M | 8.02 | 8.10 | 8.16 | 0.07 |
| LC D151N | 8.02 | 8.10 | 8.16 | 0.07 |
| LC D151P | 8.02 | 8.10 | 8.16 | 0.07 |
| LC D151Q | 8.02 | 8.10 | 8.16 | 0.07 |
| LC D151S | 8.02 | 8.10 | 8.16 | 0.07 |
| LC D151T | 8.02 | 8.10 | 8.16 | 0.07 |
| LC D151V | 8.02 | 8.10 | 8.16 | 0.07 |
| LC D151W | 8.02 | 8.10 | 8.16 | 0.07 |
| LC D151Y | 8.02 | 8.10 | 8.16 | 0.07 |
| LC E161A | 8.02 | 8.10 | 8.16 | 0.07 |
| LC E161F | 8.02 | 8.10 | 8.16 | 0.07 |
| LC E161G | 8.02 | 8.10 | 8.16 | 0.07 |
| LC E161H | 8.02 | 8.10 | 8.16 | 0.07 |
| LC E161I | 8.02 | 8.10 | 8.16 | 0.07 |
| LC E161L | 8.02 | 8.10 | 8.16 | 0.07 |
| LC E161M | 8.02 | 8.10 | 8.16 | 0.07 |
| LC E161N | 8.02 | 8.10 | 8.16 | 0.07 |
| LC E161P | 8.02 | 8.10 | 8.16 | 0.07 |
| LC E161Q | 8.02 | 8.10 | 8.16 | 0.07 |
| LC E161S | 8.02 | 8.10 | 8.16 | 0.07 |
| LC E161T | 8.02 | 8.10 | 8.16 | 0.07 |
| LC E161V | 8.02 | 8.10 | 8.16 | 0.07 |
| LC E161W | 8.02 | 8.10 | 8.16 | 0.07 |
| LC E161Y | 8.02 | 8.10 | 8.16 | 0.07 |
| LC E165A | 8.02 | 8.10 | 8.16 | 0.07 |
| LC E165F | 8.02 | 8.10 | 8.16 | 0.07 |
| LC E165G | 8.02 | 8.10 | 8.16 | 0.07 |
| LC E165H | 8.02 | 8.10 | 8.16 | 0.07 |
| LC E165I | 8.02 | 8.10 | 8.16 | 0.07 |
| LC E165L | 8.02 | 8.10 | 8.16 | 0.07 |
| LC E165M | 8.02 | 8.10 | 8.16 | 0.07 |
| LC E165N | 8.02 | 8.10 | 8.16 | 0.07 |
| LC E165P | 8.02 | 8.10 | 8.16 | 0.07 |
| LC E165Q | 8.02 | 8.10 | 8.16 | 0.07 |
| LC E165S | 8.02 | 8.10 | 8.16 | 0.07 |
| LC E165T | 8.02 | 8.10 | 8.16 | 0.07 |
| LC E165V | 8.02 | 8.10 | 8.16 | 0.07 |
| LC E165W | 8.02 | 8.10 | 8.16 | 0.07 |
| LC E165Y | 8.02 | 8.10 | 8.16 | 0.07 |
| LC D167A | 8.02 | 8.10 | 8.16 | 0.07 |
| LC D167F | 8.02 | 8.10 | 8.16 | 0.07 |
| LC D167G | 8.02 | 8.10 | 8.16 | 0.07 |
| LC D167H | 8.02 | 8.10 | 8.16 | 0.07 |
| LC D167I | 8.02 | 8.10 | 8.16 | 0.07 |
| LC D167L | 8.02 | 8.10 | 8.16 | 0.07 |
| LC D167M | 8.02 | 8.10 | 8.16 | 0.07 |
| LC D167N | 8.02 | 8.10 | 8.16 | 0.07 |
| LC D167P | 8.02 | 8.10 | 8.16 | 0.07 |
| LC D167Q | 8.02 | 8.10 | 8.16 | 0.07 |

Figure 51 (cont.)

| Variant | Acidic to Neutral | | | |
| --- | --- | --- | --- | --- |
| | IgG1 / IgG1 | pI / IgG1 | pI / pI | delta pI |
| LC D167S | 8.02 | 8.10 | 8.16 | 0.07 |
| LC D167T | 8.02 | 8.10 | 8.16 | 0.07 |
| LC D167V | 8.02 | 8.10 | 8.16 | 0.07 |
| LC D167W | 8.02 | 8.10 | 8.16 | 0.07 |
| LC D167Y | 8.02 | 8.10 | 8.16 | 0.07 |
| LC D170A | 8.02 | 8.10 | 8.16 | 0.07 |
| LC D170F | 8.02 | 8.10 | 8.16 | 0.07 |
| LC D170G | 8.02 | 8.10 | 8.16 | 0.07 |
| LC D170H | 8.02 | 8.10 | 8.16 | 0.07 |
| LC D170I | 8.02 | 8.10 | 8.16 | 0.07 |
| LC D170L | 8.02 | 8.10 | 8.16 | 0.07 |
| LC D170M | 8.02 | 8.10 | 8.16 | 0.07 |
| LC D170N | 8.02 | 8.10 | 8.16 | 0.07 |
| LC D170P | 8.02 | 8.10 | 8.16 | 0.07 |
| LC D170Q | 8.02 | 8.10 | 8.16 | 0.07 |
| LC D170S | 8.02 | 8.10 | 8.16 | 0.07 |
| LC D170T | 8.02 | 8.10 | 8.16 | 0.07 |
| LC D170V | 8.02 | 8.10 | 8.16 | 0.07 |
| LC D170W | 8.02 | 8.10 | 8.16 | 0.07 |
| LC D170Y | 8.02 | 8.10 | 8.16 | 0.07 |
| LC D185A | 8.02 | 8.10 | 8.16 | 0.07 |
| LC D185F | 8.02 | 8.10 | 8.16 | 0.07 |
| LC D185G | 8.02 | 8.10 | 8.16 | 0.07 |
| LC D185H | 8.02 | 8.10 | 8.16 | 0.07 |
| LC D185I | 8.02 | 8.10 | 8.16 | 0.07 |
| LC D185L | 8.02 | 8.10 | 8.16 | 0.07 |
| LC D185M | 8.02 | 8.10 | 8.16 | 0.07 |
| LC D185N | 8.02 | 8.10 | 8.16 | 0.07 |
| LC D185P | 8.02 | 8.10 | 8.16 | 0.07 |
| LC D185Q | 8.02 | 8.10 | 8.16 | 0.07 |
| LC D185S | 8.02 | 8.10 | 8.16 | 0.07 |
| LC D185T | 8.02 | 8.10 | 8.16 | 0.07 |
| LC D185V | 8.02 | 8.10 | 8.16 | 0.07 |
| LC D185W | 8.02 | 8.10 | 8.16 | 0.07 |
| LC D185Y | 8.02 | 8.10 | 8.16 | 0.07 |
| LC E187A | 8.02 | 8.10 | 8.16 | 0.07 |
| LC E187F | 8.02 | 8.10 | 8.16 | 0.07 |
| LC E187G | 8.02 | 8.10 | 8.16 | 0.07 |
| LC E187H | 8.02 | 8.10 | 8.16 | 0.07 |
| LC E187I | 8.02 | 8.10 | 8.16 | 0.07 |
| LC E187L | 8.02 | 8.10 | 8.16 | 0.07 |
| LC E187M | 8.02 | 8.10 | 8.16 | 0.07 |
| LC E187N | 8.02 | 8.10 | 8.16 | 0.07 |
| LC E187P | 8.02 | 8.10 | 8.16 | 0.07 |
| LC E187Q | 8.02 | 8.10 | 8.16 | 0.07 |
| LC E187S | 8.02 | 8.10 | 8.16 | 0.07 |
| LC E187T | 8.02 | 8.10 | 8.16 | 0.07 |
| LC E187V | 8.02 | 8.10 | 8.16 | 0.07 |
| LC E187W | 8.02 | 8.10 | 8.16 | 0.07 |
| LC E187Y | 8.02 | 8.10 | 8.16 | 0.07 |
| LC E213A | 8.02 | 8.10 | 8.16 | 0.07 |

Figure 51 (cont.)

| Variant | Acidic to Neutral | | | |
| --- | --- | --- | --- | --- |
| | IgG1 / IgG1 | pI / IgG1 | pI / pI | delta pI |
| LC E213F | 8.02 | 8.10 | 8.16 | 0.07 |
| LC E213G | 8.02 | 8.10 | 8.16 | 0.07 |
| LC E213H | 8.02 | 8.10 | 8.16 | 0.07 |
| LC E213I | 8.02 | 8.10 | 8.16 | 0.07 |
| LC E213L | 8.02 | 8.10 | 8.16 | 0.07 |
| LC E213M | 8.02 | 8.10 | 8.16 | 0.07 |
| LC E213N | 8.02 | 8.10 | 8.16 | 0.07 |
| LC E213P | 8.02 | 8.10 | 8.16 | 0.07 |
| LC E213Q | 8.02 | 8.10 | 8.16 | 0.07 |
| LC E213S | 8.02 | 8.10 | 8.16 | 0.07 |
| LC E213T | 8.02 | 8.10 | 8.16 | 0.07 |
| LC E213V | 8.02 | 8.10 | 8.16 | 0.07 |
| LC E213W | 8.02 | 8.10 | 8.16 | 0.07 |
| LC E213Y | 8.02 | 8.10 | 8.16 | 0.07 |

Figure 52

SEQ ID NOS: 430-441

SEQ ID NO: 430 = IgG1; SEQ ID NO: 431 = IgG2; SEQ ID NO: 432 = IgG3; SEQ ID NO: 433 = IgG4; SEQ ID NO: 434 = pI-Iso1; 435=IgG-Pi-Iso2; 436=IgG-pI-Iso3; 437= IgG-pI-IF16-ISO; 438= IgG-pI-IF10-iso; 439=ISO(-); 440=ISO (+RR); 441=ISO(+)

|          | 118 | 119 | 120 | 121 | 122 | 123 | 124 | 125 | 126 | 127 | 128 | 129 | 130 | 131 | 132 | 133 | 134 | 135 | 136 | 137 |
|----------|-----|-----|-----|-----|-----|-----|-----|-----|-----|-----|-----|-----|-----|-----|-----|-----|-----|-----|-----|-----|
| IgG1     | A | S | T | K | G | P | S | V | F | P | L | A | P | S | S | K | S | T | S | G |
| IgG2     | A | S | T | K | G | P | S | V | F | P | L | A | P | C | S | R | S | T | S | E |
| IgG3     | A | S | T | K | G | P | S | V | F | P | L | A | P | C | S | R | S | T | S | G |
| IgG4     | A | S | T | K | G | P | S | V | F | P | L | A | P | C | S | R | S | T | S | E |
| ISO(-)   | A | S | T | K | G | P | S | V | F | P | L | A | P | S | S | K | S | T | S | G |
| ISO(+RR) | A | S | T | K | G | P | S | V | F | P | L | A | P | S | S | K | S | T | S | G |
| ISO(+)   | A | S | T | K | G | P | S | V | F | P | L | A | P | S | S | K | S | T | S | G |

|          | 138 | 139 | 140 | 141 | 142 | 143 | 144 | 145 | 146 | 147 | 148 | 149 | 150 | 151 | 152 | 153 | 154 | 155 | 156 | 157 |
|----------|-----|-----|-----|-----|-----|-----|-----|-----|-----|-----|-----|-----|-----|-----|-----|-----|-----|-----|-----|-----|
| IgG1     | G | T | A | A | L | G | C | L | V | K | D | Y | F | P | E | P | V | T | V | S |
| IgG2     | S | T | A | A | L | G | C | L | V | K | D | Y | F | P | E | P | V | T | V | S |
| IgG3     | G | T | A | A | L | G | C | L | V | K | D | Y | F | P | E | P | V | T | V | S |
| IgG4     | S | T | A | A | L | G | C | L | V | K | D | Y | F | P | E | P | V | T | V | S |
| ISO(-)   | G | T | A | A | L | G | C | L | V | K | D | Y | F | P | E | P | V | T | V | S |
| ISO(+RR) | G | T | A | A | L | G | C | L | V | K | D | Y | F | P | E | P | V | T | V | S |
| ISO(+)   | G | T | A | A | L | G | C | L | V | K | D | Y | F | P | E | P | V | T | V | S |

|          | 158 | 159 | 160 | 161 | 162 | 163 | 164 | 165 | 166 | 167 | 168 | 169 | 170 | 171 | 172 | 173 | 174 | 175 | 176 | 177 |
|----------|-----|-----|-----|-----|-----|-----|-----|-----|-----|-----|-----|-----|-----|-----|-----|-----|-----|-----|-----|-----|
| IgG1     | W | N | S | G | A | L | T | S | G | V | H | T | F | P | A | V | L | Q | S | S |
| IgG2     | W | N | S | G | A | L | T | S | G | V | H | T | F | P | A | V | L | Q | S | S |
| IgG3     | W | N | S | G | A | L | T | S | G | V | H | T | F | P | A | V | L | Q | S | S |
| IgG4     | W | N | S | G | A | L | T | S | G | V | H | T | F | P | A | V | L | Q | S | S |
| ISO(-)   | W | N | S | G | A | L | T | S | G | V | H | T | F | P | A | V | L | Q | S | S |
| ISO(+RR) | W | N | S | G | A | L | T | S | G | V | H | T | F | P | A | V | L | Q | S | S |
| ISO(+)   | W | N | S | G | A | L | T | S | G | V | H | T | F | P | A | V | L | Q | S | S |

|          | 178 | 179 | 180 | 181 | 182 | 183 | 184 | 185 | 186 | 187 | 188 | 189 | 190 | 191 | 192 | 193 | 194 | 195 | 196 | 197 |
|----------|-----|-----|-----|-----|-----|-----|-----|-----|-----|-----|-----|-----|-----|-----|-----|-----|-----|-----|-----|-----|
| IgG1     | G | L | Y | S | L | S | S | V | V | T | V | P | S | S | S | L | G | T | Q | T |
| IgG2     | G | L | Y | S | L | S | S | V | V | T | V | P | S | S | N | F | G | T | Q | T |
| IgG3     | G | L | Y | S | L | S | S | V | V | T | V | P | S | S | S | L | G | T | Q | T |
| IgG4     | G | L | Y | S | L | S | S | V | V | T | V | P | S | S | S | L | G | T | K | T |
| ISO(-)   | G | L | Y | S | L | S | S | V | V | T | V | P | S | S | S | L | G | T | Q | T |
| ISO(+RR) | G | L | Y | S | L | S | S | V | V | T | V | P | S | S | S | L | G | T | K | T |
| ISO(+)   | G | L | Y | S | L | S | S | V | V | T | V | P | S | S | S | L | G | T | K | T |

|          | 198 | 199 | 200 | 201 | 202 | 203 | 204 | 205 | 206 | 207 | 208 | 209 | 210 | 211 | 212 | 213 | 214 | 215 | 216 | 217 |
|----------|-----|-----|-----|-----|-----|-----|-----|-----|-----|-----|-----|-----|-----|-----|-----|-----|-----|-----|-----|-----|
| IgG1     | Y | I | C | N | V | N | H | K | P | S | N | T | K | V | D | K | K | V | E | P |
| IgG2     | Y | T | C | N | V | D | H | K | P | S | N | T | K | V | D | K | T | V | E | R |
| IgG3     | Y | T | C | N | V | N | H | K | P | S | N | T | K | V | D | K | R | V | E | L |
| IgG4     | Y | T | C | N | V | D | H | K | P | S | N | T | K | V | D | K | R | V | E | S |
| ISO(-)   | Y | T | C | N | V | D | H | K | P | S | N | T | K | V | D | K | K | V | E | P |
| ISO(+RR) | Y | T | C | N | V | N | H | K | P | S | N | T | K | V | D | K | K | V | E | R |
| ISO(+)   | Y | T | C | N | V | N | H | K | P | S | N | T | K | V | D | K | K | V | E | P |

Figure 52 (cont.)

|         | 218 | 219 | 220 | ... | ... | 221 | 222 | 223 | 224 | 225 | ... | 226 | 227 | 228 | 229 | 230 | 231 | 232 | 233 | 234 |
|---------|-----|-----|-----|-----|-----|-----|-----|-----|-----|-----|-----|-----|-----|-----|-----|-----|-----|-----|-----|-----|
| IgG1    | K   | S   | C   |     |     | D   | K   | T   | H   | T   |     | C   | P   | P   | C   | P   | A   | P   | E   | L   |
| IgG2    | K   | C   | C   |     |     |     | V   |     | E   |     |     | C   | P   | P   | C   | P   | A   | P   | P   | V   |
| IgG3    | K   | T   | P   | L   | G   | D   | T   | T   | H   | T   | ... | C   | P   | R   | C   | P   | A   | P   | E   | L   |
| IgG4    | K   | Y   | G   |     |     |     |     |     | P   | P   |     | C   | P   | S   | C   | P   | A   | P   | E   | F   |
| ISO(-)  | K   | S   | C   |     |     | D   | K   | T   | H   | T   |     | C   | P   | P   | C   | P   | A   | P   | E   | L   |
| ISO(+RR)| K   | S   | C   |     |     | D   | K   | T   | H   | T   |     | C   | P   | R   | C   | P   | A   | P   | E   | L   |
| ISO(+)  | K   | S   | C   |     |     | D   | K   | T   | H   | T   |     | C   | P   | P   | C   | P   | A   | P   | E   | L   |

|         | 235 | 236 | 237 | 238 | 239 | 240 | 241 | 242 | 243 | 244 | 245 | 246 | 247 | 248 | 249 | 250 | 251 | 252 | 253 | 254 |
|---------|-----|-----|-----|-----|-----|-----|-----|-----|-----|-----|-----|-----|-----|-----|-----|-----|-----|-----|-----|-----|
| IgG1    | L   | G   | G   | P   | S   | V   | F   | L   | F   | P   | P   | K   | P   | K   | D   | T   | L   | M   | I   | S   |
| IgG2    | A   |     | G   | P   | S   | V   | F   | L   | F   | P   | P   | K   | P   | K   | D   | T   | L   | M   | I   | S   |
| IgG3    | L   | G   | G   | P   | S   | V   | F   | L   | F   | P   | P   | K   | P   | K   | D   | T   | L   | M   | I   | S   |
| IgG4    | L   | G   | G   | P   | S   | V   | F   | L   | F   | P   | P   | K   | P   | K   | D   | T   | L   | M   | I   | S   |
| ISO(-)  | L   | G   | G   | P   | S   | V   | F   | L   | F   | P   | P   | K   | P   | K   | D   | T   | L   | M   | I   | S   |
| ISO(+RR)| L   | G   | G   | P   | S   | V   | F   | L   | F   | P   | P   | K   | P   | K   | D   | T   | L   | M   | I   | S   |
| ISO(+)  | L   | G   | G   | P   | S   | V   | F   | L   | F   | P   | P   | K   | P   | K   | D   | T   | L   | M   | I   | S   |

|         | 255 | 256 | 257 | 258 | 259 | 260 | 261 | 262 | 263 | 264 | 265 | 266 | 267 | 268 | 269 | 270 | 271 | 272 | 273 | 274 |
|---------|-----|-----|-----|-----|-----|-----|-----|-----|-----|-----|-----|-----|-----|-----|-----|-----|-----|-----|-----|-----|
| IgG1    | R   | T   | P   | E   | V   | T   | C   | V   | V   | V   | D   | V   | S   | H   | E   | D   | P   | E   | V   | K   |
| IgG2    | R   | T   | P   | E   | V   | T   | C   | V   | V   | V   | D   | V   | S   | H   | E   | D   | P   | E   | V   | Q   |
| IgG3    | R   | T   | P   | E   | V   | T   | C   | V   | V   | V   | D   | V   | S   | H   | E   | D   | P   | E   | V   | Q   |
| IgG4    | R   | T   | P   | E   | V   | T   | C   | V   | V   | V   | D   | V   | S   | Q   | E   | D   | P   | E   | V   | Q   |
| ISO(-)  | R   | T   | P   | E   | V   | T   | C   | V   | V   | V   | D   | V   | S   | H   | E   | D   | P   | E   | V   | Q   |
| ISO(+RR)| R   | T   | P   | E   | V   | T   | C   | V   | V   | V   | D   | V   | S   | H   | E   | D   | P   | E   | V   | K   |
| ISO(+)  | R   | T   | P   | E   | V   | T   | C   | V   | V   | V   | D   | V   | S   | H   | E   | D   | P   | E   | V   | K   |

|         | 275 | 276 | 277 | 278 | 279 | 280 | 281 | 282 | 283 | 284 | 285 | 286 | 287 | 288 | 289 | 290 | 291 | 292 | 293 | 294 |
|---------|-----|-----|-----|-----|-----|-----|-----|-----|-----|-----|-----|-----|-----|-----|-----|-----|-----|-----|-----|-----|
| IgG1    | F   | N   | W   | Y   | V   | D   | G   | V   | E   | V   | H   | N   | A   | K   | T   | K   | P   | R   | E   | E   |
| IgG2    | F   | N   | W   | Y   | V   | D   | G   | V   | E   | V   | H   | N   | A   | K   | T   | K   | P   | R   | E   | E   |
| IgG3    | F   | K   | W   | Y   | V   | D   | G   | V   | E   | V   | H   | N   | A   | K   | T   | K   | P   | R   | E   | E   |
| IgG4    | F   | N   | W   | Y   | V   | D   | G   | V   | E   | V   | H   | N   | A   | K   | T   | K   | P   | R   | E   | E   |
| ISO(-)  | F   | N   | W   | Y   | V   | D   | G   | V   | E   | V   | H   | N   | A   | K   | T   | K   | P   | R   | E   | E   |
| ISO(+RR)| F   | K   | W   | Y   | V   | D   | G   | V   | E   | V   | H   | N   | A   | K   | T   | K   | P   | R   | E   | E   |
| ISO(+)  | F   | K   | W   | Y   | V   | D   | G   | V   | E   | V   | H   | N   | A   | K   | T   | K   | P   | R   | E   | E   |

|         | 295 | 296 | 297 | 298 | 299 | 300 | 301 | 302 | 303 | 304 | 305 | 306 | 307 | 308 | 309 | 310 | 311 | 312 | 313 | 314 |
|---------|-----|-----|-----|-----|-----|-----|-----|-----|-----|-----|-----|-----|-----|-----|-----|-----|-----|-----|-----|-----|
| IgG1    | Q   | Y   | N   | S   | T   | Y   | R   | V   | V   | S   | V   | L   | T   | V   | L   | H   | Q   | D   | W   | L   |
| IgG2    | Q   | F   | N   | S   | T   | F   | R   | V   | V   | S   | V   | L   | T   | V   | V   | H   | Q   | D   | W   | L   |
| IgG3    | Q   | Y   | N   | S   | T   | F   | R   | V   | V   | S   | V   | L   | T   | V   | L   | H   | Q   | D   | W   | L   |
| IgG4    | Q   | F   | N   | S   | T   | Y   | R   | V   | V   | S   | V   | L   | T   | V   | L   | H   | Q   | D   | W   | L   |
| ISO(-)  | Q   | Y   | N   | S   | T   | Y   | R   | V   | V   | S   | V   | L   | T   | V   | L   | H   | Q   | D   | W   | L   |
| ISO(+RR)| Q   | Y   | N   | S   | T   | Y   | R   | V   | V   | S   | V   | L   | T   | V   | L   | H   | Q   | D   | W   | L   |
| ISO(+)  | Q   | Y   | N   | S   | T   | Y   | R   | V   | V   | S   | V   | L   | T   | V   | L   | H   | Q   | D   | W   | L   |

Figure 52 (cont.)

|         | 315 | 316 | 317 | 318 | 319 | 320 | 321 | 322 | 323 | 324 | 325 | 326 | 327 | 328 | 329 | 330 | 331 | 332 | 333 | 334 |
|---------|-----|-----|-----|-----|-----|-----|-----|-----|-----|-----|-----|-----|-----|-----|-----|-----|-----|-----|-----|-----|
| IgG1    | N | G | K | E | Y | K | C | K | V | S | N | K | A | L | P | A | P | I | E | K |
| IgG2    | N | G | K | E | Y | K | C | K | V | S | N | K | G | L | P | A | P | I | E | K |
| IgG3    | N | G | K | E | Y | K | C | K | V | S | N | K | A | L | P | A | P | I | E | K |
| IgG4    | N | G | K | E | Y | K | C | K | V | S | N | K | G | L | P | S | S | I | E | K |
| ISO(-)  | N | G | K | E | Y | K | C | K | V | S | N | K | A | L | P | A | P | I | E | K |
| ISO(+RR)| N | G | K | E | Y | K | C | K | V | S | N | K | A | L | P | A | P | I | E | K |
| ISO(+)  | N | G | K | E | Y | K | C | K | V | S | N | K | A | L | P | A | P | I | E | K |

|         | 335 | 336 | 337 | 338 | 339 | 340 | 341 | 342 | 343 | 344 | 345 | 346 | 347 | 348 | 349 | 350 | 351 | 352 | 353 | 354 |
|---------|-----|-----|-----|-----|-----|-----|-----|-----|-----|-----|-----|-----|-----|-----|-----|-----|-----|-----|-----|-----|
| IgG1    | T | I | S | K | A | K | G | Q | P | R | E | P | Q | V | Y | T | L | P | P | S |
| IgG2    | T | I | S | K | T | K | G | Q | P | R | E | P | Q | V | Y | T | L | P | P | S |
| IgG3    | T | I | S | K | T | K | G | Q | P | R | E | P | Q | V | Y | T | L | P | P | S |
| IgG4    | T | I | S | K | A | K | G | Q | P | R | E | P | Q | V | Y | T | L | P | P | S |
| ISO(-)  | T | I | S | K | A | K | G | Q | P | R | E | P | Q | V | Y | T | L | P | P | S |
| ISO(+RR)| T | I | S | K | A | K | G | Q | P | R | E | P | Q | V | Y | T | L | P | P | S |
| ISO(+)  | T | I | S | K | A | K | G | Q | P | R | E | P | Q | V | Y | T | L | P | P | S |

|         | 355 | 356 | 357 | 358 | 359 | 360 | 361 | 362 | 363 | 364 | 365 | 366 | 367 | 368 | 369 | 370 | 371 | 372 | 373 | 374 |
|---------|-----|-----|-----|-----|-----|-----|-----|-----|-----|-----|-----|-----|-----|-----|-----|-----|-----|-----|-----|-----|
| IgG1    | R | E | E | M | T | K | N | Q | V | S | L | T | C | L | V | K | G | F | Y | P |
| IgG2    | R | E | E | M | T | K | N | Q | V | S | L | T | C | L | V | K | G | F | Y | P |
| IgG3    | R | E | E | M | T | K | N | Q | V | S | L | T | C | L | V | K | G | F | Y | P |
| IgG4    | Q | E | E | M | T | K | N | Q | V | S | L | T | C | L | V | K | G | F | Y | P |
| ISO(-)  | Q | E | E | M | T | K | N | Q | V | S | L | T | C | L | V | K | G | F | Y | P |
| ISO(+RR)| R | E | E | M | T | K | N | Q | V | S | L | T | C | L | V | K | G | F | Y | P |
| ISO(+)  | R | E | E | M | T | K | N | Q | V | S | L | T | C | L | V | K | G | F | Y | P |

|         | 375 | 376 | 377 | 378 | 379 | 380 | 381 | 382 | 383 | 384 | 385 | 386 | 387 | 388 | 389 | 390 | 391 | 392 | 393 | 394 |
|---------|-----|-----|-----|-----|-----|-----|-----|-----|-----|-----|-----|-----|-----|-----|-----|-----|-----|-----|-----|-----|
| IgG1    | S | D | I | A | V | E | W | E | S | N | G | Q | P | E | N | N | Y | K | T | T |
| IgG2    | S | D | I | A | V | E | W | E | S | N | G | Q | P | E | N | N | Y | K | T | T |
| IgG3    | S | D | I | A | V | E | W | E | S | S | G | Q | P | E | N | N | Y | N | T | T |
| IgG4    | S | D | I | A | V | E | W | E | S | N | G | Q | P | E | N | N | Y | K | T | T |
| ISO(-)  | S | D | I | A | V | E | W | E | S | S | G | Q | P | E | N | N | Y | N | T | T |
| ISO(+RR)| S | D | I | A | V | E | W | E | S | N | G | Q | P | E | N | N | Y | K | T | T |
| ISO(+)  | S | D | I | A | V | E | W | E | S | N | G | Q | P | E | N | N | Y | K | T | T |

|         | 395 | 396 | 397 | 398 | 399 | 400 | 401 | 402 | 403 | 404 | 405 | 406 | 407 | 408 | 409 | 410 | 411 | 412 | 413 | 414 |
|---------|-----|-----|-----|-----|-----|-----|-----|-----|-----|-----|-----|-----|-----|-----|-----|-----|-----|-----|-----|-----|
| IgG1    | P | P | V | L | D | S | D | G | S | F | F | L | Y | S | K | L | T | V | D | K |
| IgG2    | P | P | M | L | D | S | D | G | S | F | F | L | Y | S | K | L | T | V | D | K |
| IgG3    | P | P | M | L | D | S | D | G | S | F | F | L | Y | S | K | L | T | V | D | K |
| IgG4    | P | P | V | L | D | S | D | G | S | F | F | L | Y | S | R | L | T | V | D | K |
| ISO(-)  | P | P | M | L | D | S | D | G | S | F | F | L | Y | S | K | L | T | V | D | K |
| ISO(+RR)| P | P | V | L | D | S | D | G | S | F | F | L | Y | S | K | L | T | V | D | K |
| ISO(+)  | P | P | V | L | D | S | D | G | S | F | F | L | Y | S | K | L | T | V | D | K |

Figure 52 (cont.)

| | 415 | 416 | 417 | 418 | 419 | 420 | 421 | 422 | 423 | 424 | 425 | 426 | 427 | 428 | 429 | 430 | 431 | 432 | 433 | 434 |
|---|---|---|---|---|---|---|---|---|---|---|---|---|---|---|---|---|---|---|---|---|
| IgG1 | S | R | W | Q | Q | G | N | V | F | S | C | S | V | M | H | E | A | L | H | N |
| IgG2 | S | R | W | Q | Q | G | N | V | F | S | C | S | V | M | H | E | A | L | H | N |
| IgG3 | S | R | W | Q | Q | G | N | I | F | S | C | S | V | M | H | E | A | L | H | N |
| IgG4 | S | R | W | Q | E | G | N | V | F | S | C | S | V | M | H | E | A | L | H | N |
| ISO(-) | S | R | W | Q | E | G | N | V | F | S | C | S | V | M | H | E | A | L | H | N |
| ISO(+RR) | S | R | W | Q | Q | G | N | V | F | S | C | S | V | M | H | E | A | L | H | N |
| ISO(+) | S | R | W | Q | Q | G | N | V | F | S | C | S | V | M | H | E | A | L | H | N |

| | 435 | 436 | 437 | 438 | 439 | 440 | 441 | 442 | 443 | 444 | 445 | 446 | 447 |
|---|---|---|---|---|---|---|---|---|---|---|---|---|---|
| IgG1 | H | Y | T | Q | K | S | L | S | L | S | P | G | K |
| IgG2 | H | Y | T | Q | K | S | L | S | L | S | P | G | K |
| IgG3 | R | F | T | Q | K | S | L | S | L | S | P | G | K |
| IgG4 | H | Y | T | Q | K | S | L | S | L | S | L | G | K |
| ISO(-) | H | Y | T | Q | K | S | L | S | L | S | P | G | K |
| ISO(+RR) | H | Y | T | Q | K | S | L | S | L | S | P | G | K |
| ISO(+) | H | Y | T | Q | K | S | L | S | L | S | P | G | K |

SEQ ID NOS: 430-441

SEQ ID NO: 430 = IgG1; SEQ ID NO: 431 = IgG2; SEQ ID NO: 432 = IgG3; SEQ ID NO: 433 = IgG4; SEQ ID NO: 434 = pI-Iso1; 435=IgG-Pi-Iso2; 436=IgG-pI-Iso3; 437= IgG-pI-IF16-ISO; 438= IgG-pI-IF10-Iso; 439=ISO(-); 440=ISO (+RR); 441=ISO(+)

Figure 53

ISO(-) (SEQ ID NO: 74)

ASTKGPSVFPLAPSSKSTSGGTAALGCLVKDYFPEPVTVSWNSGALTSGVHTFPAVLQSSGLYSLSSVVTVPSSSL
GTQTYTCNVDHKPSNTKVDKKVEPKSCDKTHTCPPCPAPELLGGPSVFLFPPKPKDTLMISRTPEVTCVVVDVS
HEDPEVQFNWYVDGVEVHNAKTKPREEQYNSTYRVVSVLTVLHQDWLNGKEYKCKVSNKALPAPIEKTISKAK
GQPREPQVYTLPPSQEEMTKNQVSLTCLVKGFYPSDIAVEWESSGQPENNYNTTPPMLDSDGSFFLYSKLTVD
KSRWQEGNVFSCSVMHEALHNHYTQKSLSLSPG

ISO(+)(SEQ ID NO: 75)

ASTKGPSVFPLAPSSKSTSGGTAALGCLVKDYFPEPVTVSWNSGALTSGVHTFPAVLQSSGLYSLSSVVTVPSSSL
GTKTYTCNVNHKPSNTKVDKKVEPKSCDKTHTCPPCPAPELLGGPSVFLFPPKPKDTLMISRTPEVTCVVVDVSH
EDPEVKFKWYVDGVEVHNAKTKPREEQYNSTYRVVSVLTVLHQDWLNGKEYKCKVSNKALPAPIEKTISKAKG
QPREPQVYTLPPSREEMTKNQVSLTCLVKGFYPSDIAVEWESNGQPENNYKTTPPVLDSDGSFFLYSKLTVDKS
RWQQGNVFSCSVMHEALHNHYTQKSLSLSPGK

ISO(+RR) (SEQ ID NO: 76)

ASTKGPSVFPLAPSSKSTSGGTAALGCLVKDYFPEPVTVSWNSGALTSGVHTFPAVLQSSGLYSLSSVVTVPSSSL
GTKTYTCNVNHKPSNTKVDKKVERKSCDKTHTCPRCPAPELLGGPSVFLFPPKPKDTLMISRTPEVTCVVVDVSH
EDPEVKFKWYVDGVEVHNAKTKPREEQYNSTYRVVSVLTVLHQDWLNGKEYKCKVSNKALPAPIEKTISKAKG
QPREPQVYTLPPSREEMTKNQVSLTCLVKGFYPSDIAVEWESNGQPENNYKTTPPVLDSDGSFFLYSKLTVDKS
RWQQGNVFSCSVMHEALHNHYTQKSLSLSPGK

Anti-VEGF  ISO(-) Heavy Chain (SEQ ID NO: 77)

EVQLVESGGGLVQPGGSLRLSCAASGYTFTNYGMNWVRQAPGKGLEWVGWINTYTGEPTYAADFKRRFTFSL
DTSKSTAYLQMNSLRAEDTAVYYCAKYPHYYGSSHWYFDVWGQGTLVTVSSASTKGPSVFPLAPSSKSTSGGT
AALGCLVKDYFPEPVTVSWNSGALTSGVHTFPAVLQSSGLYSLSSVVTVPSSSLGTQTYTCNVDHKPSNTKVDK
KVEPKSCDKTHTCPPCPAPELLGGPSVFLFPPKPKDTLMISRTPEVTCVVVDVSHEDPEVQFNWYVDGVEVHN
AKTKPREEQYNSTYRVVSVLTVLHQDWLNGKEYKCKVSNKALPAPIEKTISKAKGQPREPQVYTLPPSQEEMTK
NQVSLTCLVKGFYPSDIAVEWESSGQPENNYNTTPPMLDSDGSFFLYSKLTVDKSRWQEGNVFSCSVMHEALH
NHYTQKSLSLSPG

Anti-VEGF  ISO(+) Heavy Chain (SEQ ID NO: 78)

EVQLVESGGGLVQPGGSLRLSCAASGYTFTNYGMNWVRQAPGKGLEWVGWINTYTGEPTYAADFKRRFTFSL
DTSKSTAYLQMNSLRAEDTAVYYCAKYPHYYGSSHWYFDVWGQGTLVTVSSASTKGPSVFPLAPSSKSTSGGT
AALGCLVKDYFPEPVTVSWNSGALTSGVHTFPAVLQSSGLYSLSSVVTVPSSSLGTKTYTCNVNHKPSNTKVDKK
VEPKSCDKTHTCPPCPAPELLGGPSVFLFPPKPKDTLMISRTPEVTCVVVDVSHEDPEVKFKWYVDGVEVHNAK
TKPREEQYNSTYRVVSVLTVLHQDWLNGKEYKCKVSNKALPAPIEKTISKAKGQPREPQVYTLPPSREEMTKNQ
VSLTCLVKGFYPSDIAVEWESNGQPENNYKTTPPVLDSDGSFFLYSKLTVDKSRWQQGNVFSCSVMHEALHNH
YTQKSLSLSPGK

Figure 53 (Cont)

Anti-VEGF_ISO(+RR) Heavy Chain (SEQ ID NO: 79)

EVQLVESGGGLVQPGGSLRLSCAASGYTFTNYGMNWVRQAPGKGLEWVGWINTYTGEPTYAADFKRRFTFSL
DTSKSTAYLQMNSLRAEDTAVYYCAKYPHYYGSSHWYFDVWGQGTLVTVSSASTKGPSVFPLAPSSKSTSGGT
AALGCLVKDYFPEPVTVSWNSGALTSGVHTFPAVLQSSGLYSLSSVVTVPSSSLGTKTYTCNVNHKPSNTKVDKK
VERKSCDKTHTCPRCPAPELLGGPSVFLFPPKPKDTLMISRTPEVTCVVVDVSHEDPEVKFKWYVDGVEVHNAK
TKPREEQYNSTYRVVSVLTVLHQDWLNGKEYKCKVSNKALPAPIEKTISKAKGQPREPQVYTLPPSREEMTKNQ
VSLTCLVKGFYPSDIAVEWESNGQPENNYKTTPPVLDSDGSFFLYSKLTVDKSRWQQGNVFSCSVMHEALHNH
YTQKSLSLSPGK

Figure 54

Heavy Chain 1 of XENP10783 Anti-VEGF_ISO(-) x IgG1(WT) (SEQ ID NO: 80)

EVQLVESGGGLVQPGGSLRLSCAASGYTFTNYGMNWVRQAPGKGLEWVGWINTYTGEPTYAADFKRRFTFSL
DTSKSTAYLQMNSLRAEDTAVYYCAKYPHYYGSSHWYFDVWGQGTLVTVSSASTKGPSVFPLAPSSKSTSGGT
AALGCLVKDYFPEPVTVSWNSGALTSGVHTFPAVLQSSGLYSLSSVVTVPSSSLGTQTYTCNVDHKPSNTKVDK
KVEPKSCDKTHTCPPCPAPELLGGPSVFLFPPKPKDTLMISRTPEVTCVVVDVSHEDPEVQFNWYVDGVEVHN
AKTKPREEQYNSTYRVVSVLTVLHQDWLNGKEYKCKVSNKALPAPIEKTISKAKGQPREPQVYTLPPSQEEMTK
NQVSLTCLVKGFYPSDIAVEWESSGQPENNYNTTPPMLDSDGSFFLYSKLTVDKSRWQEGNVFSCSVMHEALH
NHYTQKSLSLSPG

Heavy Chain 2 of XENP10783 Anti-VEGF_ISO(-) x IgG1(WT) (SEQ ID NO: 81)

EVQLVESGGGLVQPGGSLRLSCAASGYTFTNYGMNWVRQAPGKGLEWVGWINTYTGEPTYAADFKRRFTFSL
DTSKSTAYLQMNSLRAEDTAVYYCAKYPHYYGSSHWYFDVWGQGTLVTVSSASTKGPSVFPLAPSSKSTSGGT
AALGCLVKDYFPEPVTVSWNSGALTSGVHTFPAVLQSSGLYSLSSVVTVPSSSLGTQTYICNVNHKPSNTKVDKK
VEPKSCDKTHTCPPCPAPELLGGPSVFLFPPKPKDTLMISRTPEVTCVVVDVSHEDPEVKFNWYVDGVEVHNAK
TKPREEQYNSTYRVVSVLTVLHQDWLNGKEYKCKVSNKALPAPIEKTISKAKGQPREPQVYTLPPSREEMTKNQ
VSLTCLVKGFYPSDIAVEWESNGQPENNYKTTPPVLDSDGSFFLYSKLTVDKSRWQQGNVFSCSVMHEALHNH
YTQKSLSLSPGK

Light Chain of XENP10783 Anti-VEGF_ISO(-) x IgG1(WT) (SEQ ID NO: 82)

DIQMTQSPSSLSASVGDRVTITCSASQDISNYLNWYQQKPGKAPKVLIYFTSSLHSGVPSRFSGSGSGTDFTLTIS
SLQPEDFATYYCQQYSTVPWTFGQGTKVEIKRTVAAPSVFIFPPSDEQLKSGTASVVCLLNNFYPREAKVQWKV
DNALQSGNSQESVTEQDSKDSTYSLSSTLTLSKADYEKHKVYACEVTHQGLSSPVTKSFNRGEC

| | |
|---|---|
| ISO(-)/ISO(-) Homodimer | pI = 6.6 |
| ISO(-)/IgG1(WT) Heterodimer | pI = 7.3 |
| ISO(WT)/ISO(WT) Homodimer | pI = 8.0 |

Figure 55

Heavy Chain 1 of XENP10784 Anti-VEGF_ISO(+RR) x IgG1(WT) (SEQ ID NO: 83)

EVQLVESGGGLVQPGGSLRLSCAASGYTFTNYGMNWVRQAPGKGLEWVGWINTYTGEPTYAADFKRRFTFSL
DTSKSTAYLQMNSLRAEDTAVYYCAKYPHYYGSSHWYFDVWGQGTLVTVSSASTKGPSVFPLAPSSKSTSGGT
AALGCLVKDYFPEPVTVSWNSGALTSGVHTFPAVLQSSGLYSLSSVVTVPSSSLGTKTYTCNVNHKPSNTKVDKK
VERKSCDKTHTCPRCPAPELLGGPSVFLFPPKPKDTLMISRTPEVTCVVVDVSHEDPEVKFKWYVDGVEVHNAK
TKPREEQYNSTYRVVSVLTVLHQDWLNGKEYKCKVSNKALPAPIEKTISKAKGQPREPQVYTLPPSREEMTKNQ
VSLTCLVKGFYPSDIAVEWESNGQPENNYKTTPPVLDSDGSFFLYSKLTVDKSRWQQGNVFSCSVMHEALHNH
YTQKSLSLSPGK

Heavy Chain 2 of XENP10784 Anti-VEGF_ISO(+RR) x IgG1(WT) (SEQ ID NO:84)

EVQLVESGGGLVQPGGSLRLSCAASGYTFTNYGMNWVRQAPGKGLEWVGWINTYTGEPTYAADFKRRFTFSL
DTSKSTAYLQMNSLRAEDTAVYYCAKYPHYYGSSHWYFDVWGQGTLVTVSSASTKGPSVFPLAPSSKSTSGGT
AALGCLVKDYFPEPVTVSWNSGALTSGVHTFPAVLQSSGLYSLSSVVTVPSSSLGTQTYICNVNHKPSNTKVDKK
VEPKSCDKTHTCPPCPAPELLGGPSVFLFPPKPKDTLMISRTPEVTCVVVDVSHEDPEVKFNWYVDGVEVHNAK
TKPREEQYNSTYRVVSVLTVLHQDWLNGKEYKCKVSNKALPAPIEKTISKAKGQPREPQVYTLPPSREEMTKNQ
VSLTCLVKGFYPSDIAVEWESNGQPENNYKTTPPVLDSDGSFFLYSKLTVDKSRWQQGNVFSCSVMHEALHNH
YTQKSLSLSPGK

Light Chain of XENP10784 Anti-VEGF_ISO(+RR) x IgG1(WT) (SEQ ID NO: 85)

DIQMTQSPSSLSASVGDRVTITCSASQDISNYLNWYQQKPGKAPKVLIYFTSSLHSGVPSRFSGSGSGTDFTLTIS
SLQPEDFATYYCQQYSTVPWTFGQGTKVEIKRTVAAPSVFIFPPSDEQLKSGTASVVCLLNNFYPREAKVQWKV
DNALQSGNSQESVTEQDSKDSTYSLSSTLTLSKADYEKHKVYACEVTHQGLSSPVTKSFNRGEC

IgG1(WT)/IgG1(WT) Homodimer        pI = 8.0

ISO(+RR)/IgG1(WT) Heterodimer       pI = 8.3

ISO(+RR)/ISO(+RR) Homodimer        pI = 8.5

Figure 56

Heavy Chain 1 of XENP10896 Anti-VEGF_ISO(-) x ISO(+RR) (SEQ ID NO: 86)

EVQLVESGGGLVQPGGSLRLSCAASGYTFTNYGMNWVRQAPGKGLEWVGWINTYTGEPTYAADFKRRFTFSL
DTSKSTAYLQMNSLRAEDTAVYYCAKYPHYYGSSHWYFDVWGQGTLVTVSSASTKGPSVFPLAPSSKSTSGGT
AALGCLVKDYFPEPVTVSWNSGALTSGVHTFPAVLQSSGLYSLSSVVTVPSSSLGTQTYTCNVDHKPSNTKVDK
KVEPKSCDKTHTCPPCPAPELLGGPSVFLFPPKPKDTLMISRTPEVTCVVVDVSHEDPEVQFNWYVDGVEVHN
AKTKPREEQYNSTYRVVSVLTVLHQDWLNGKEYKCKVSNKALPAPIEKTISKAKGQPREPQVYTLPPSQEEMTK
NQVSLTCLVKGFYPSDIAVEWESSGQPENNYNTTPPMLDSDGSFFLYSKLTVDKSRWQEGNVFSCSVMHEALH
NHYTQKSLSLSPG

Heavy Chain 2 of XENP10896 Anti-VEGF_ISO(-) x ISO(+RR) (SEQ ID NO: 87)

EVQLVESGGGLVQPGGSLRLSCAASGYTFTNYGMNWVRQAPGKGLEWVGWINTYTGEPTYAADFKRRFTFSL
DTSKSTAYLQMNSLRAEDTAVYYCAKYPHYYGSSHWYFDVWGQGTLVTVSSASTKGPSVFPLAPSSKSTSGGT
AALGCLVKDYFPEPVTVSWNSGALTSGVHTFPAVLQSSGLYSLSSVVTVPSSSLGTKTYTCNVNHKPSNTKVDKK
VERKSCDKTHTCPRCPAPELLGGPSVFLFPPKPKDTLMISRTPEVTCVVVDVSHEDPEVKFKWYVDGVEVHNAK
TKPREEQYNSTYRVVSVLTVLHQDWLNGKEYKCKVSNKALPAPIEKTISKAKGQPREPQVYTLPPSREEMTKNQ
VSLTCLVKGFYPSDIAVEWESNGQPENNYKTTPPVLDSDGSFFLYSKLTVDKSRWQQGNVFSCSVMHEALHNH
YTQKSLSLSPGK

Light Chain of XENP10896 Anti-VEGF_ISO(-) x ISO(+RR) (SEQ ID NO: 88)

DIQMTQSPSSLSASVGDRVTITCSASQDISNYLNWYQQKPGKAPKVLIYFTSSLHSGVPSRFSGSGSGTDFTLTIS
SLQPEDFATYYCQQYSTVPWTFGQGTKVEIKRTVAAPSVFIFPPSDEQLKSGTASVVCLLNNFYPREAKVQWKV
DNALQSGNSQESVTEQDSKDSTYSLSSTLTLSKADYEKHKVYACEVTHQGLSSPVTKSFNRGEC

| | | |
|---|---|---|
| ISO(-)/ISO(-) | Homodimer | pI = 6.6 |
| ISO(-)/ISO(+RR) | Heterodimer | pI = 7.9 |
| ISO(+RR)/ISO(+RR) | Homodimer | pI = 8.5 |

Figure 57

Heavy Chain 1 of XENP10901 Anti-VEGF_ISO(-) x ISO(+)(SEQ ID NO: 89)

EVQLVESGGGLVQPGGSLRLSCAASGYTFTNYGMNWVRQAPGKGLEWVGWINTYTGEPTYAADFKRRFTFSL
DTSKSTAYLQMNSLRAEDTAVYYCAKYPHYYGSSHWYFDVWGQGTLVTVSSASTKGPSVFPLAPSSKSTSGGT
AALGCLVKDYFPEPVTVSWNSGALTSGVHTFPAVLQSSGLYSLSSVVTVPSSSLGTQTYTCNVDHKPSNTKVDK
KVEPKSCDKTHTCPPCPAPELLGGPSVFLFPPKPKDTLMISRTPEVTCVVVDVSHEDPEVQFNWYVDGVEVHN
AKTKPREEQYNSTYRVVSVLTVLHQDWLNGKEYKCKVSNKALPAPIEKTISKAKGQPREPQVYTLPPSQEEMTK
NQVSLTCLVKGFYPSDIAVEWESSGQPENNYNTTPPMLDSDGSFFLYSKLTVDKSRWQEGNVFSCSVMHEALH
NHYTQKSLSLSPG

Heavy Chain 2 of XENP10901 Anti-VEGF_ISO(-) x ISO(+)(SEQ ID NO: 90)

EVQLVESGGGLVQPGGSLRLSCAASGYTFTNYGMNWVRQAPGKGLEWVGWINTYTGEPTYAADFKRRFTFSL
DTSKSTAYLQMNSLRAEDTAVYYCAKYPHYYGSSHWYFDVWGQGTLVTVSSASTKGPSVFPLAPSSKSTSGGT
AALGCLVKDYFPEPVTVSWNSGALTSGVHTFPAVLQSSGLYSLSSVVTVPSSSLGTKTYTCNVNHKPSNTKVDKK
VEPKSCDKTHTCPPCPAPELLGGPSVFLFPPKPKDTLMISRTPEVTCVVVDVSHEDPEVKFKWYVDGVEVHNAK
TKPREEQYNSTYRVVSVLTVLHQDWLNGKEYKCKVSNKALPAPIEKTISKAKGQPREPQVYTLPPSREEMTKNQ
VSLTCLVKGFYPSDIAVEWESNGQPENNYKTTPPVLDSDGSFFLYSKLTVDKSRWQQGNVFSCSVMHEALHNH
YTQKSLSLSPGK

Light Chain of XENP10901 Anti-VEGF_ISO(-) x ISO(+)(SEQ ID NO:91)

DIQMTQSPSSLSASVGDRVTITCSASQDISNYLNWYQQKPGKAPKVLIYFTSSLHSGVPSRFSGSGSGTDFTLTIS
SLQPEDFATYYCQQYSTVPWTFGQGTKVEIKRTVAAPSVFIFPPSDEQLKSGTASVVCLLNNFYPREAKVQWKV
DNALQSGNSQESVTEQDSKDSTYSLSSTLTLSKADYEKHKVYACEVTHQGLSSPVTKSFNRGEC

ISO(-)/ISO(-)  Homodimer   pI = 6.6

ISO(-)/ISO(+)  Heterodimer  pI = 7.6

ISO(+)/ISO(+)  Homodimer   pI = 8.3

Figure 58

| Variant | # of sub(s) | pI / pI | pI / WT | WT/ WT | avg delta pI |
|---|---|---|---|---|---|
| G137E/N203D/K274Q/R355Q/K392N/Q419E/K447_ | 7 | 6.43 | 7.14 | 8.02 | -0.79 |
| G137E/N203D/K274Q/R355Q/K392N/Q419E | 6 | 6.58 | 7.30 | 8.02 | -0.72 |
| G137E/N203D/K274Q/R355Q/K392N/K447_ | 6 | 6.58 | 7.30 | 8.02 | -0.72 |
| G137E/N203D/K274Q/R355Q/Q419E/K447_ | 6 | 6.58 | 7.30 | 8.02 | -0.72 |
| G137E/N203D/K274Q/K392N/Q419E/K447_ | 6 | 6.58 | 7.30 | 8.02 | -0.72 |
| G137E/N203D/R355Q/K392N/Q419E/K447_ | 6 | 6.58 | 7.30 | 8.02 | -0.72 |
| G137E/K274Q/R355Q/K392N/Q419E/K447_ | 6 | 6.58 | 7.30 | 8.02 | -0.72 |
| N203D/K274Q/R355Q/K392N/Q419E/K447_ | 6 | 6.58 | 7.30 | 8.02 | -0.72 |
| G137E/N203D/K274Q/R355Q/K392N | 5 | 6.76 | 7.46 | 8.02 | -0.63 |
| G137E/N203D/K274Q/R355Q/Q419E | 5 | 6.76 | 7.46 | 8.02 | -0.63 |
| G137E/N203D/K274Q/R355Q/K447_ | 5 | 6.76 | 7.46 | 8.02 | -0.63 |
| G137E/N203D/K274Q/K392N/Q419E | 5 | 6.76 | 7.46 | 8.02 | -0.63 |
| G137E/N203D/K274Q/K392N/K447_ | 5 | 6.76 | 7.46 | 8.02 | -0.63 |
| G137E/N203D/K274Q/Q419E/K447_ | 5 | 6.76 | 7.46 | 8.02 | -0.63 |
| G137E/N203D/R355Q/K392N/Q419E | 5 | 6.76 | 7.46 | 8.02 | -0.63 |
| G137E/N203D/R355Q/K392N/K447_ | 5 | 6.76 | 7.46 | 8.02 | -0.63 |
| G137E/N203D/R355Q/Q419E/K447_ | 5 | 6.76 | 7.46 | 8.02 | -0.63 |
| G137E/N203D/K392N/Q419E/K447_ | 5 | 6.76 | 7.46 | 8.02 | -0.63 |
| G137E/K274Q/R355Q/K392N/Q419E | 5 | 6.76 | 7.46 | 8.02 | -0.63 |
| G137E/K274Q/R355Q/K392N/K447_ | 5 | 6.76 | 7.46 | 8.02 | -0.63 |
| G137E/K274Q/R355Q/Q419E/K447_ | 5 | 6.76 | 7.46 | 8.02 | -0.63 |
| G137E/K274Q/K392N/Q419E/K447_ | 5 | 6.76 | 7.46 | 8.02 | -0.63 |
| G137E/R355Q/K392N/Q419E/K447_ | 5 | 6.76 | 7.46 | 8.02 | -0.63 |
| N203D/K274Q/R355Q/K392N/Q419E | 5 | 6.76 | 7.46 | 8.02 | -0.63 |
| N203D/K274Q/R355Q/K392N/K447_ | 5 | 6.76 | 7.46 | 8.02 | -0.63 |
| N203D/K274Q/R355Q/Q419E/K447_ | 5 | 6.76 | 7.46 | 8.02 | -0.63 |
| N203D/K274Q/K392N/Q419E/K447_ | 5 | 6.76 | 7.46 | 8.02 | -0.63 |
| N203D/R355Q/K392N/Q419E/K447_ | 5 | 6.76 | 7.46 | 8.02 | -0.63 |
| K274Q/R355Q/K392N/Q419E/K447_ | 5 | 6.76 | 7.46 | 8.02 | -0.63 |
| G137E/N203D/K274Q/R355Q | 4 | 7.00 | 7.61 | 8.02 | -0.51 |
| G137E/N203D/K274Q/K392N | 4 | 7.00 | 7.61 | 8.02 | -0.51 |

Figure 58 (cont.)

| Variant | # of sub(s) | pI / pI | pI / WT | WT/ WT | avg delta pI |
|---|---|---|---|---|---|
| G137E/N203D/K274Q/Q419E | 4 | 7.00 | 7.61 | 8.02 | -0.51 |
| G137E/N203D/K274Q/K447_ | 4 | 7.00 | 7.61 | 8.02 | -0.51 |
| G137E/N203D/R355Q/K392N | 4 | 7.00 | 7.61 | 8.02 | -0.51 |
| G137E/N203D/R355Q/Q419E | 4 | 7.00 | 7.61 | 8.02 | -0.51 |
| G137E/N203D/R355Q/K447_ | 4 | 7.00 | 7.61 | 8.02 | -0.51 |
| G137E/N203D/K392N/Q419E | 4 | 7.00 | 7.61 | 8.02 | -0.51 |
| G137E/N203D/K392N/K447_ | 4 | 7.00 | 7.61 | 8.02 | -0.51 |
| G137E/N203D/Q419E/K447_ | 4 | 7.00 | 7.61 | 8.02 | -0.51 |
| G137E/K274Q/R355Q/K392N | 4 | 7.00 | 7.61 | 8.02 | -0.51 |
| G137E/K274Q/R355Q/Q419E | 4 | 7.00 | 7.61 | 8.02 | -0.51 |
| G137E/K274Q/R355Q/K447_ | 4 | 7.00 | 7.61 | 8.02 | -0.51 |
| G137E/K274Q/K392N/Q419E | 4 | 7.00 | 7.61 | 8.02 | -0.51 |
| G137E/K274Q/K392N/K447_ | 4 | 7.00 | 7.61 | 8.02 | -0.51 |
| G137E/K274Q/Q419E/K447_ | 4 | 7.00 | 7.61 | 8.02 | -0.51 |
| G137E/R355Q/K392N/Q419E | 4 | 7.00 | 7.61 | 8.02 | -0.51 |
| G137E/R355Q/K392N/K447_ | 4 | 7.00 | 7.61 | 8.02 | -0.51 |
| G137E/R355Q/Q419E/K447_ | 4 | 7.00 | 7.61 | 8.02 | -0.51 |
| G137E/K392N/Q419E/K447_ | 4 | 7.00 | 7.61 | 8.02 | -0.51 |
| N203D/K274Q/R355Q/K392N | 4 | 7.00 | 7.61 | 8.02 | -0.51 |
| N203D/K274Q/R355Q/Q419E | 4 | 7.00 | 7.61 | 8.02 | -0.51 |
| N203D/K274Q/R355Q/K447_ | 4 | 7.00 | 7.61 | 8.02 | -0.51 |
| N203D/K274Q/K392N/Q419E | 4 | 7.00 | 7.61 | 8.02 | -0.51 |
| N203D/K274Q/K392N/K447_ | 4 | 7.00 | 7.61 | 8.02 | -0.51 |
| N203D/K274Q/Q419E/K447_ | 4 | 7.00 | 7.61 | 8.02 | -0.51 |
| N203D/R355Q/K392N/Q419E | 4 | 7.00 | 7.61 | 8.02 | -0.51 |
| N203D/R355Q/K392N/K447_ | 4 | 7.00 | 7.61 | 8.02 | -0.51 |
| N203D/R355Q/Q419E/K447_ | 4 | 7.00 | 7.61 | 8.02 | -0.51 |
| N203D/K392N/Q419E/K447_ | 4 | 7.00 | 7.61 | 8.02 | -0.51 |
| K274Q/R355Q/K392N/Q419E | 4 | 7.00 | 7.61 | 8.02 | -0.51 |
| K274Q/R355Q/K392N/K447_ | 4 | 7.00 | 7.61 | 8.02 | -0.51 |
| K274Q/R355Q/Q419E/K447_ | 4 | 7.00 | 7.61 | 8.02 | -0.51 |
| K274Q/K392N/Q419E/K447_ | 4 | 7.00 | 7.61 | 8.02 | -0.51 |
| R355Q/K392N/Q419E/K447_ | 4 | 7.00 | 7.61 | 8.02 | -0.51 |

Figure 5B (cont.)

| Variant | # of sub(s) | pI/pI | pI/WT | WT/WT | avg delta pI |
|---|---|---|---|---|---|
| G137E/N203D/K274Q | 3 | 7.30 | 7.74 | 8.02 | -0.36 |
| G137E/N203D/R355Q | 3 | 7.30 | 7.74 | 8.02 | -0.36 |
| G137E/N203D/K392N | 3 | 7.30 | 7.74 | 8.02 | -0.36 |
| G137E/N203D/Q419E | 3 | 7.30 | 7.74 | 8.02 | -0.36 |
| G137E/N203D/K447_ | 3 | 7.30 | 7.74 | 8.02 | -0.36 |
| G137E/K274Q/R355Q | 3 | 7.30 | 7.74 | 8.02 | -0.36 |
| G137E/K274Q/K392N | 3 | 7.30 | 7.74 | 8.02 | -0.36 |
| G137E/K274Q/Q419E | 3 | 7.30 | 7.74 | 8.02 | -0.36 |
| G137E/K274Q/K447_ | 3 | 7.30 | 7.74 | 8.02 | -0.36 |
| G137E/R355Q/K392N | 3 | 7.30 | 7.74 | 8.02 | -0.36 |
| G137E/R355Q/Q419E | 3 | 7.30 | 7.74 | 8.02 | -0.36 |
| G137E/R355Q/K447_ | 3 | 7.30 | 7.74 | 8.02 | -0.36 |
| G137E/K392N/Q419E | 3 | 7.30 | 7.74 | 8.02 | -0.36 |
| G137E/K392N/K447_ | 3 | 7.30 | 7.74 | 8.02 | -0.36 |
| G137E/Q419E/K447_ | 3 | 7.30 | 7.74 | 8.02 | -0.36 |
| N203D/K274Q/R355Q | 3 | 7.30 | 7.74 | 8.02 | -0.36 |
| N203D/K274Q/K392N | 3 | 7.30 | 7.74 | 8.02 | -0.36 |
| N203D/K274Q/Q419E | 3 | 7.30 | 7.74 | 8.02 | -0.36 |
| N203D/K274Q/K447_ | 3 | 7.30 | 7.74 | 8.02 | -0.36 |
| N203D/R355Q/K392N | 3 | 7.30 | 7.74 | 8.02 | -0.36 |
| N203D/R355Q/Q419E | 3 | 7.30 | 7.74 | 8.02 | -0.36 |
| N203D/R355Q/K447_ | 3 | 7.30 | 7.74 | 8.02 | -0.36 |
| N203D/K392N/Q419E | 3 | 7.30 | 7.74 | 8.02 | -0.36 |
| N203D/K392N/K447_ | 3 | 7.30 | 7.74 | 8.02 | -0.36 |
| N203D/Q419E/K447_ | 3 | 7.30 | 7.74 | 8.02 | -0.36 |
| K274Q/R355Q/K392N | 3 | 7.30 | 7.74 | 8.02 | -0.36 |
| K274Q/R355Q/Q419E | 3 | 7.30 | 7.74 | 8.02 | -0.36 |
| K274Q/R355Q/K447_ | 3 | 7.30 | 7.74 | 8.02 | -0.36 |
| K274Q/K392N/Q419E | 3 | 7.30 | 7.74 | 8.02 | -0.36 |
| K274Q/K392N/K447_ | 3 | 7.30 | 7.74 | 8.02 | -0.36 |
| K274Q/Q419E/K447_ | 3 | 7.30 | 7.74 | 8.02 | -0.36 |
| R355Q/K392N/Q419E | 3 | 7.30 | 7.74 | 8.02 | -0.36 |
| R355Q/K392N/K447_ | 3 | 7.30 | 7.74 | 8.02 | -0.36 |

Figure 58 (cont.)

| Variant | # of sub(s) | pI / pI | pI / WT | WT/ WT | avg delta pI |
|---|---|---|---|---|---|
| R355Q/Q419E/K447_ | 3 | 7.30 | 7.74 | 8.02 | -0.36 |
| K392N/Q419E/K447_ | 3 | 7.30 | 7.74 | 8.02 | -0.36 |
| G137E/N203D | 2 | 7.61 | 7.85 | 8.02 | -0.21 |
| G137E/K274Q | 2 | 7.61 | 7.85 | 8.02 | -0.21 |
| G137E/R355Q | 2 | 7.61 | 7.85 | 8.02 | -0.21 |
| G137E/K392N | 2 | 7.61 | 7.85 | 8.02 | -0.21 |
| G137E/Q419E | 2 | 7.61 | 7.85 | 8.02 | -0.21 |
| G137E/K447_ | 2 | 7.61 | 7.85 | 8.02 | -0.21 |
| N203D/K274Q | 2 | 7.61 | 7.85 | 8.02 | -0.21 |
| N203D/R355Q | 2 | 7.61 | 7.85 | 8.02 | -0.21 |
| N203D/K392N | 2 | 7.61 | 7.85 | 8.02 | -0.21 |
| N203D/Q419E | 2 | 7.61 | 7.85 | 8.02 | -0.21 |
| N203D/K447_ | 2 | 7.61 | 7.85 | 8.02 | -0.21 |
| K274Q/R355Q | 2 | 7.61 | 7.85 | 8.02 | -0.21 |
| K274Q/K392N | 2 | 7.61 | 7.85 | 8.02 | -0.21 |
| K274Q/Q419E | 2 | 7.61 | 7.85 | 8.02 | -0.21 |
| K274Q/K447_ | 2 | 7.61 | 7.85 | 8.02 | -0.21 |
| R355Q/K392N | 2 | 7.61 | 7.85 | 8.02 | -0.21 |
| R355Q/Q419E | 2 | 7.61 | 7.85 | 8.02 | -0.21 |
| R355Q/K447_ | 2 | 7.61 | 7.85 | 8.02 | -0.21 |
| K392N/Q419E | 2 | 7.61 | 7.85 | 8.02 | -0.21 |
| K392N/K447_ | 2 | 7.61 | 7.85 | 8.02 | -0.21 |
| Q419E/K447_ | 2 | 7.61 | 7.85 | 8.02 | -0.21 |
| G137E | 1 | 7.85 | 7.94 | 8.02 | -0.09 |
| N203D | 1 | 7.85 | 7.94 | 8.02 | -0.09 |
| K274Q | 1 | 7.85 | 7.94 | 8.02 | -0.09 |
| R355Q | 1 | 7.85 | 7.94 | 8.02 | -0.09 |
| K392N | 1 | 7.85 | 7.94 | 8.02 | -0.09 |
| Q419E | 1 | 7.85 | 7.94 | 8.02 | -0.09 |
| K447_ | 1 | 7.85 | 7.94 | 8.02 | -0.09 |

Figure 59

| Variant | # of sub(s) | pI / pI | pI / WT | WT / WT | avg delta pI |
|---|---|---|---|---|---|
| Q196K/P217R/P228R/N276K/H435R | 5 | 8.53 | 8.32 | 8.02 | 0.25 |
| Q196K/P217R/P228R/N276K | 4 | 8.45 | 8.27 | 8.02 | 0.22 |
| Q196K/P217R/P228R/H435R | 4 | 8.46 | 8.28 | 8.02 | 0.22 |
| Q196K/P217R/N276K/H435R | 4 | 8.45 | 8.27 | 8.02 | 0.22 |
| Q196K/P228R/N276K/H435R | 4 | 8.45 | 8.27 | 8.02 | 0.22 |
| P217R/P228R/N276K/H435R | 4 | 8.46 | 8.28 | 8.02 | 0.22 |
| Q196K/P217R/P228R | 3 | 8.37 | 8.22 | 8.02 | 0.17 |
| Q196K/P217R/N276K | 3 | 8.37 | 8.22 | 8.02 | 0.17 |
| Q196K/P217R/H435R | 3 | 8.37 | 8.22 | 8.02 | 0.17 |
| Q196K/P228R/N276K | 3 | 8.37 | 8.22 | 8.02 | 0.17 |
| Q196K/P228R/H435R | 3 | 8.37 | 8.22 | 8.02 | 0.17 |
| Q196K/N276K/H435R | 3 | 8.37 | 8.22 | 8.02 | 0.17 |
| P217R/P228R/N276K | 3 | 8.37 | 8.22 | 8.02 | 0.17 |
| P217R/P228R/H435R | 3 | 8.37 | 8.22 | 8.02 | 0.18 |
| P217R/N276K/H435R | 3 | 8.37 | 8.22 | 8.02 | 0.17 |
| P228R/N276K/H435R | 3 | 8.37 | 8.22 | 8.02 | 0.17 |
| Q196K/P217R | 2 | 8.27 | 8.16 | 8.02 | 0.13 |
| Q196K/P228R | 2 | 8.27 | 8.16 | 8.02 | 0.13 |
| Q196K/N276K | 2 | 8.27 | 8.16 | 8.02 | 0.13 |
| Q196K/H435R | 2 | 8.28 | 8.16 | 8.02 | 0.13 |
| P217R/P228R | 2 | 8.27 | 8.16 | 8.02 | 0.13 |
| P217R/N276K | 2 | 8.28 | 8.16 | 8.02 | 0.13 |
| P217R/H435R | 2 | 8.28 | 8.16 | 8.02 | 0.13 |
| P228R/N276K | 2 | 8.27 | 8.16 | 8.02 | 0.13 |
| P228R/H435R | 2 | 8.28 | 8.16 | 8.02 | 0.13 |
| N276K/H435R | 2 | 8.27 | 8.16 | 8.02 | 0.13 |
| Q196K | 1 | 8.16 | 8.10 | 8.02 | 0.07 |
| P217R | 1 | 8.16 | 8.10 | 8.02 | 0.07 |
| P228R | 1 | 8.16 | 8.10 | 8.02 | 0.07 |
| N276K | 1 | 8.16 | 8.10 | 8.02 | 0.07 |
| H435R | 1 | 8.16 | 8.10 | 8.02 | 0.07 |

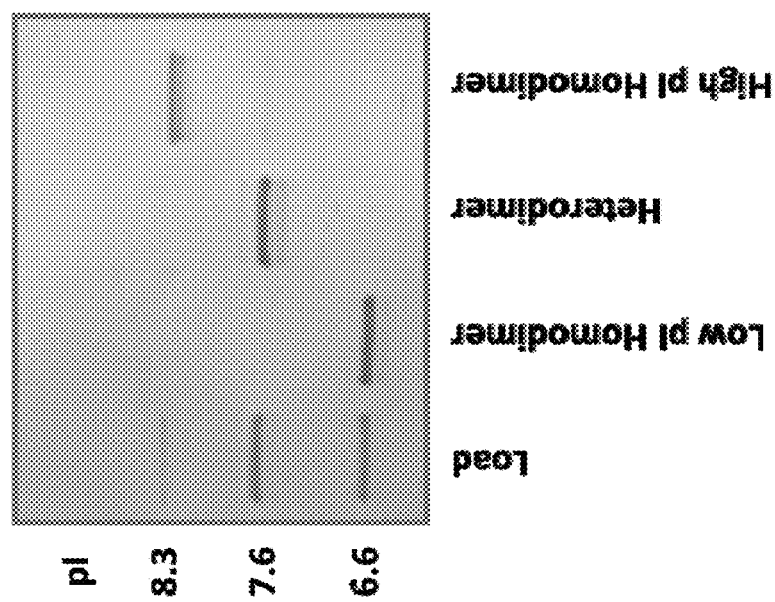
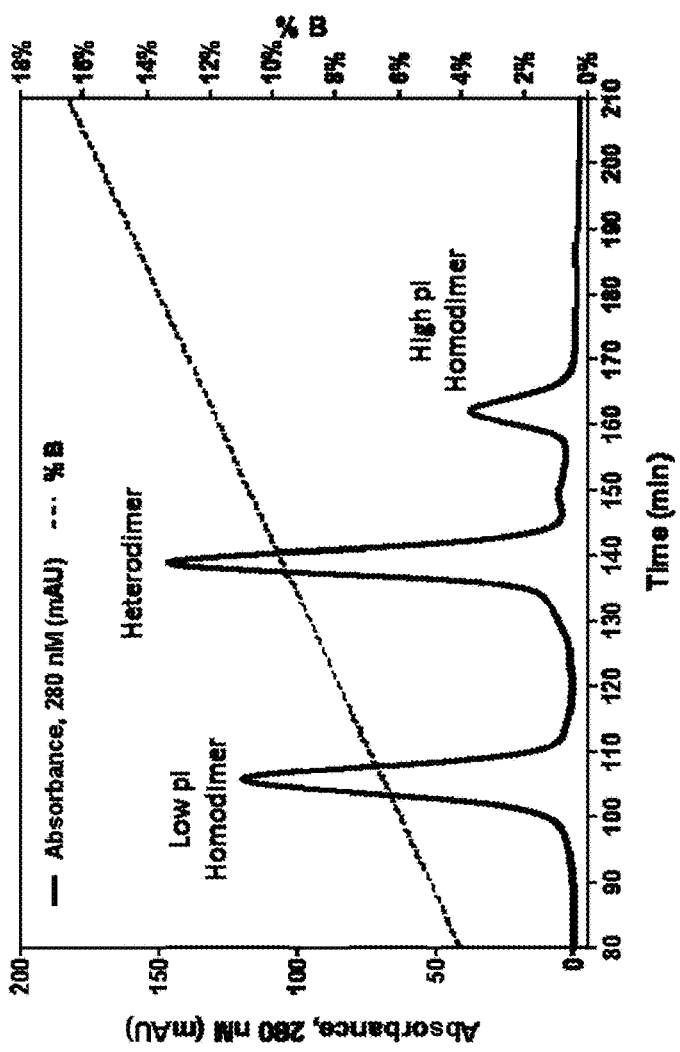
Figure 63
Purification of XENP10901: anti-VEGF ISO(-) x ISO(+) mAb where A, B, C, D can be
- immunoglobulin domain(s): (e.g., Fab, VH, VL, scFv, scFv$_2$, scFab, dAb)
- peptide(s)
- cytokine (e.g., IL-2, IL-10, IL-12, GCSF, GM-CSF)
- chemokine (e.g., RANTES, CXCL9, CXCL10, CXCL12)
- hormone (e.g., FSH, growth hormone)
- immune receptor (e.g., CTLA-4, TNFRI, TNFRII, other TNFSF, other TNFRSF)
- blood factor (e.g., Factor VII, Factor VIII, Factor IX)

Figure 65

Humanized Anti-CD3 VH with Kabat CDRs underlined (SEQ ID NO: 92)

EVQLVESGGGLVQPGGSLRLSCAASGFTFNTYAMNWVRQAPGKGLEWVGRIRSKYNNYATYYADSVKGRFTI
SRDDSKNTLYLQMNSLRAEDTAVYYCVRHGNFGNSYVSWFAYWGQGTLVTVSS

Humanized Anti-CD3 VL with Kabat CDRs underlined (SEQ ID NO: 93)

QAVVTQEPSLTVSPGGTVTLTCGSSTGAVTTSNYANWVQQKPGQAPRGLIGGTNKRAPGVPARFSGSLLGGK
AALTLSGAQPEDEAEYYCALWYSNLWVFGGGTKLTVL

Humanized Anti-CD19 VH with Kabat CDRs underlined (SEQ ID NO:94)

EVQLVESGGGLVKPGGSLKLSCAASGYTFTSYVMHWVRQAPGKGLEWIGYINPYNDGTKYNEKFQGRVTISSD
KSISTAYMELSSLRSEDTAMYYCARGTYYYGTRVFDYWGQGTLVTVSS

Humanized Anti-CD19 VL with Kabat CDRs underlined (SEQ ID NO:95)

DIVMTQSPATLSLSPGERATLSCRSSKSLQNVNGNTYLYWFQQKPGQSPQLLIYRMSNLNSGVPDRFSGSGSGT
EFTLTISSLEPEDFAVYYCMQHLEYPITFGAGTKLEIK

Anti-CD32b VH with Kabat CDRs underlined (SEQ ID NO: 96)

EVQLVESGGGLVSPGGSLKLSCVASGFAFSSYDMSWVRQTPEKRLEWVAKINSAGGRTNYPDTVKGRFTISRD
NAENTLYLQMSSLKSEDTAMYYCAGHSYDYPFTYWGQGTLVTVSA

Anti-CD32b VL with Kabat CDRs underlined (SEQ ID NO:97)

DVVLTQSPATLSVTPGDSVSLSCRASQGISNNLHWYQQKSHESPRLLIKYASQSISGIPSRFSGSGSGTDFTLSINS
VETEDFGMYFCQQSDSWPHTFGGGTKLEIK

Anti-CD32b VH with Kabat CDRs underlined (SEQ ID NO: 98)

EVKVVESGGGLVQPGGSLKLSCAASGFTFSAYSMSWVRQTPEKRLEWVAYITNGGGRTYYPDTVEGRFTISRD
NAKNTLYLQMSSLKSEDTAMYYCARHDYYVNYAMDYWGHGTSVTVSS

Anti-CD32b VL with Kabat CDRs underlined (SEQ ID NO:99)

DIVLIQSPATLSVTPGDSVSLSCRASHTISDNLHWYQQKSHESPRLLIKYASQSISGIPSRFSGSGSGTDFTLSINSV
ETEDFGMYFCQQSDSWPHTFGAGTKLELK

Anti-CD40 VH with Kabat CDRs underlined (SEQ ID NO:100)

DIQLQQSGPGLVKPSQSLSLTCSVTGYSITTNYNWNWIRQFPGNKLEWMGYIRYDGTSEYTPSLKNRVSITRDT
SMNQFFLRLTSVTPEDTATYYCARLDYWGQGTSVTVSS

Anti-CD40 VL with Kabat CDRs underlined (SEQ ID NO: 101)

DAVMTQNPLSLPVSLGDEASISCRSSQSLENSNGNTFLNWFFQKPGQSPQLLIYRVSNRFSGVPDRFSGSGSGT
DFTLKISRVEAEDLGVYFCLQVTHVPYTFGGGTTLEIK

Figure 65 – (Cont)

Anti-CD40 VH with Kabat CDRs underlined (SEQ ID NO: 102)

QVKLEESGPGLVAPSQSLSITCTVSGFSLSRYSVYWVRQPPGKGLEWLGMMWGGGSTDYNSALKSRLSISKDT
SKSQVFLKMNSLQTDDTAMYYCVRTDGDYWGQGTSVTVSS

Anti-CD40 VL with Kabat CDRs underlined (SEQ ID NO: 103)

ELQLTQSPLSLPVSLGDQASISCRSSQSLVNSNGNTYLHWYLQKPGQSPKLLIYKVSNRFSGVPDRFSGSGSGTD
FTLKISRVEAEDLGVYFCSQSTHVPWTFGGGTKLEIK

Figure 66

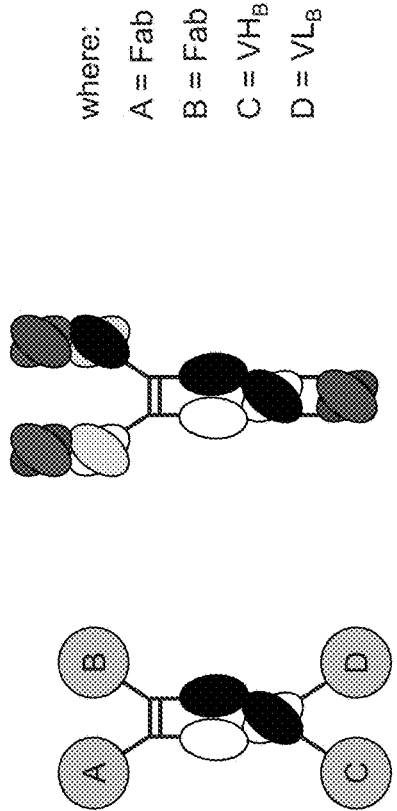

where:
A = Fab
B = Fab
C = VH$_B$
D = VL$_B$

Heavy Chain 1 of anti-CD19 x anti-CD3 mAb-Fv [HC ISO(-) (VH)] (SEQ ID NO:104)

EVQLVESGGGLVKPGGSLKLSCAASGYTFTSYVMHWVRQAPGKGLEWIGYINPYNDGTKYNEKFQGRVTISSDKSISTAYMELSSLRSEDTAMYYCARGTYYYGTRVFDYWGQG
TLVTVSSASTKGPSVFPLAPSSKSTSGGTAALGCLVKDYFPEPVTVSWNSGALTSGVHTFPAVLQSSGLYSLSSVVTVPSSSLGTQTYTCNVDHKPSNTKVDKKVEPKSCDKTHTCP
PCPAPELLGGPSVFLFPPKPKDTLMISRTPEVTCVVVDVSHEDPEVQFNWYVDGVEVHNAKTKPREEQYNSTYRVVSVLTVLHQDWLNGKEYKCKVSNKALPAPIEKTISKAKGQ
PREPQVYTLPPSQEEMTKNQVSLTCLVKGFYPSDIAVEWESSGQPENNYNTTPPMLDSDGSFFLYSKLTVDKSRWQEGNVFSCSVMHEALHNHYTQKSLSLSPGSSDKTHTSPP
SPSGEVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYV
SWFAYWGQGTLVTVSS

Heavy Chain 2 of anti-CD19 x anti-CD3 mAb-Fv [HC ISO(+RR) (VL)] (SEQ ID NO: 105)

EVQLVESGGGLVKPGGSLKLSCAASGYTFTSYVMHWVRQAPGKGLEWIGYINPYNDGTKYNEKFQGRVTISSDKSISTAYMELSSLRSEDTAMYYCARGTYYYGTRVFDYWGQG
TLVTVSSASTKGPSVFPLAPSSKSTSGGTAALGCLVKDYFPEPVTVSWNSGALTSGVHTFPAVLQSSGLYSLSSVVTVPSSSLGTKTYTCNVNHKPSNTKVDKKVERKSCDKTHTCP
RCPAPELLGGPSVFLFPPKPKDTLMISRTPEVTCVVVDVSHEDPEVKFKWYVDGVEVHNAKTKPREEQYNSTYRVVSVLTVLHQDWLNGKEYKCKVSNKALPAPIEKTISKAKGQ
PREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKSSDKTHTSPP
SPSGQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVL

Figure 66 (continued)

Light Chain of anti-CD19 x anti-CD3 mAb-Fv (SEQ ID NO: 106)

DIVMTQSPATLSLSPGERATLSCRSSKSLQNVNGNTYLYWFQQKPGQSPQLLIYRMSNLNSGVPDRFSGSGSGTEFTLTISSLEPEDFAVYYCMQHLEYPITFGAGTKLEIKRTVAA
PSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

ISO(-)/ISO(-) Homodimer        pI = 7.6

ISO(-)/ISO(+RR) Heterodimer    pI = 8.2

ISO(+RR)/ISO(+RR) Homodimer    pI = 8.5

Figure 67

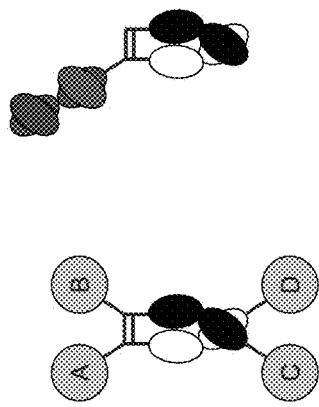

where:
A = (scFv)$_2$ (e.g., VH$_A$-(Gly$_4$Ser)$_3$-VL$_A$-(Gly$_4$Ser)-VH$_B$-(Gly$_4$Ser)$_3$-VL$_B$)
B = n.a.
C = n.a.
D = n.a.

Heavy Chain 1 of anti-CD19 x anti-CD3 scFv$_2$-Fc [HC ISO(-)] (SEQ ID NO: 107)

EPKSSDKTHTCPPCPAPELLGGPSVFLFPPKPKDTLMISRTPEVTCVVVDVSHEDPEVQFNWYVDGVEVHNAKTKPREEQYNSTYRVVSVLTVLHQDWLNGKEYKCKVSNKALP
APIEKTISKAKGQPREPQVYTLPPSQEEMTKNQVSLTCLVKGFYPSDIAVEWESSGQPENNYNTTPPMLDSDGSFFLYSKLTVDKSRWQEGNVFSCSVMHEALHNHYTQKSLSLS
PG

Heavy Chain 2 of anti-CD19 x anti-CD3 scFv$_2$-Fc [HC ISO(+RR) (scFv2)] (SEQ ID NO: 108)

EVQLVESGGGLVKPGGSLKLSCAASGYTFTSYVMHWVRQAPGKGLEWIGYINPYNDGTKYNEKFQGRVTISSDKSISTAYMELSSLRSEDTAMYYCARGTYYYGTRVFDYWGQG
TLVTVSSGGGGSGGGGSGGGGSDIVMTQSPATLSLSPGERATLSCRSSKSLQNVNGNTYLYWFQQKPGQSPQLLIYRMSNLNSGVPDRFSGSGSGTEFTLTISSLEPEDFAVYYC
MQHLEYPITFGAGTKLEIKSGGGGSEVQLVESGGGLVQPGGSLRLSCAASGFTFNTYAMNWVRQAPGKGLEWVGRIRSKYNNYATYYADSVKGRFTISRDDSKNTLYLQMNSL
RAEDTAVYYCVRHGNFGNSYVSWFAYWGQGTLVTVSSGGGGSGGGGSQAVVTQEPSLTVSPGGTVTLCGSSTGAVTTSNYANWVQQKPGQAPRGLIGGTNKRAP
GVPARFSGSLLGKAALTLSGAQPEDEAEYYCALWYSNLWVFGGGTKLTVLERKSSDKTHTCPRCPAPELLGGPSVFLFPPKPKDTLMISRTPEVTCVVVDVSHEDPEVKFKWYV
DGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTT
PPVLDSDGSFFLYSKLTVDKSRWQQGNVFSCSVMHEALHNHYTQKSLSLSPGK

ISO(-)/ISO(-) Homodimer      pI = 5.8

ISO(-)/ISO(+RR) Heterodimer  pI = 8.1

ISO(+RR)/ISO(+RR) Homodimer  pI = 8.7

Figure 68

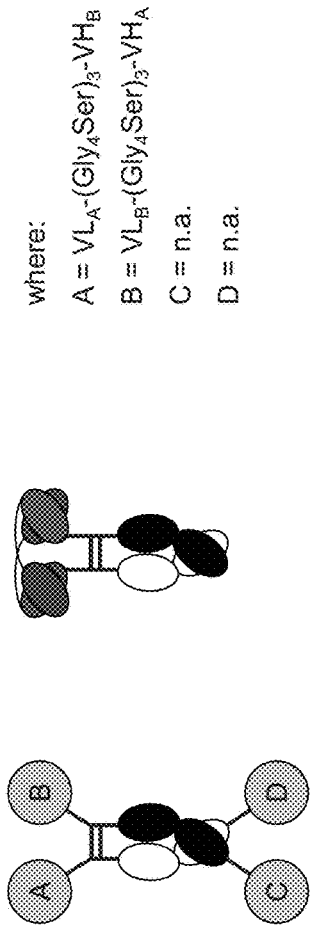

where:
A = VL$_A$-(Gly$_4$Ser)$_3$-VH$_B$
B = VL$_B$-(Gly$_4$Ser)$_3$-VH$_A$
C = n.a.
D = n.a.

Heavy Chain 1 of anti-CD19 x anti-CD3 DART-Fc [HC ISO(-)] (anti-CD19 VL/anti-CD3 VH)] (SEQ ID NO:109)

DIVMTQSPATLSLSPGERATLSCRSSKSLQNVNGNTYLYWFQQKPGQSPQLLIYRMSNLNSGVPDRFSGSGSGTEFTLTISSLEPEDFAVYYCMQHLEYPITFGAGTKLEIKGGGGS
GGGGSGGGGSEVQLVESGGGLVQPGGSLRLSCAASGFTFNTYAMNWVRQAPGKGLEWVGRIRSKYNNYATYADSVKGRFTISRDDSKNTLYLQMNSLRAEDTAVYYCVRHG
NFGNSYVSWFAYWGQGTLVTVSSEPKSSDKTHTCPPCPAPELLGGPSVFLFPPKPKDTLMISRTPEVTCVVVDVSHEDPEVQFNWYVDGVEVHNAKTKPREEQYNSTYRVSVL
TVLHQDWLNGKEYKCKVSNKALPAPIEKTISKAKGQPREPQVYTLPPSQEEMTKNQVSLTCLVKGFYPSDIAVEWESSGQPENNYNTTPPMLDSDGSFFLYSKLTVDKSRWQEG
NVFSCSVMHEALHNHYTQKSLSLSPG

Heavy Chain 2 of anti-CD19 x anti-CD3 DART-Fc [HC ISO(+RR)] (anti-CD3 VL/anti-CD19 VH)] (SEQ ID NO:110)

QAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVLGGG
GSGGGGSGGGGSEVQLVESGGGLVKPGGSLKLSCAASGYTFTSYVMHWVRQAPGKGLEWIGYINPYNDGTKYNEKFQGRVTISSDKSISTAYMELSSLRSEDTAMYYCARGTYY
YGTRVFDYWGQGTLVTVSSERKSSDKTHTCPRCPAPELLGGPSVFLFPPKPKDTLMISRTPEVTCVVVDVSHEDPEVKFNWYVDGVEVHNAKTKPREEQYNSTYRVVSVLTVLHQ
DWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCS
VMHEALHNHYTQKSLSLSPGK

ISO(-)/ISO(-) Homodimer     pI = 6.6

ISO(-)/ISO(+RR) Heterodimer     pI = 8.1

ISO(+RR)/ISO(+RR) Homodimer     pI = 8.6

Figure 69

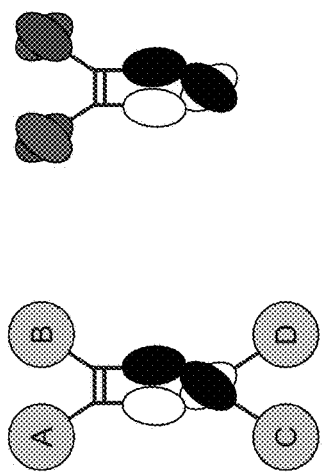

where:
A = scFv (e.g., VH$_A$-(Gly$_4$Ser)$_3$-VL$_A$)
B = scFv (e.g., VH$_B$-(Gly$_4$Ser)$_3$-VL$_B$)
C = n.a.
D = n.a.

Heavy Chain 1 of anti-CD19 x anti-CD3 scFv-Fc [HC ISO(-) (anti-CD19 scFv)] (SEQ ID NO:111)

EVQLVESGGGLVKPGGSLKLSCAASGYTFTSYVMHWVRQAPGKGLEWIGYINPYNDGTKYNEKFQGRVTISSDKSISTAYMELSSLRSEDTAMYYCARGTYYYGTRVFDYWGQG
TLVTVSSGGGGSGGGGSGGGGSDIVMTQSPATLSLSPGERATLSCRSSKSLQNVNGNTYLYWFQQKPGQSPQLLIYRMSNLNSGVPDRFSGSGSGTEFTLTISSLEPEDFAVYYC
MQHLEYPITFGAGTKLEIKEPKSSDKTHTCPPCPAPELLGGPSVFLFPPKPKDTLMISRTPEVTCVVVDVSHEDPEVQFNWYVDGVEVHNAKTKPREEQYNSTYRVVSVLTVLHQD
WLNGKEYKCKVSNKALPAPIEKTISKAKGQPREPQVYTLPPSQEEMTKNQVSLTCLVKGFYPSDIAVEWESSGQPENNYNTTPPMLDSDGSFFLYSKLTVDKSRWQEGNVFSCSV
MHEALHNHYTQKSLSLSPG

Heavy Chain 2 of anti-CD19 x anti-CD3 scFv-Fc [HC ISO(+RR) (anti-CD3 scFv)] (SEQ ID NO: 112)

EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWF
AYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPE
DEAEYYCALWYSNLWVFGGGTKLTVLERKSSDKTHTCPRCPAPELLGGPSVFLFPPKPKDTLMISRTPEVTCVVVDVSHEDPEVKFKWYVDGVEVHNAKTKPREEQYNSTYRVVS
VLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQ
GNVFSCSVMHEALHNHYTQKSLSLSPGK

ISO(-)/ISO(-) Homodimer    pI = 6.1

ISO(-)/ISO(+RR) Heterodimer    pI = 8.1

ISO(+RR)/ISO(+RR) Homodimer    pI = 8.9

Figure 70

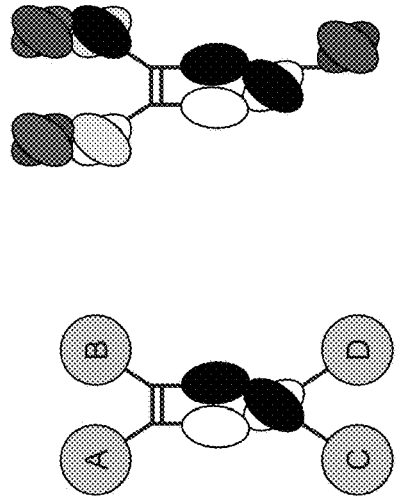

where:
A = Fab
B = Fab
C = n.a.
D = scFv (e.g., $VH_B$-$(Gly_4Ser)_3$-$VL_B$)

Heavy Chain 1 of anti-CD19 x anti-CD3 mAb-scFv [HC ISO(-)](SEQ ID NO: 113)

EVQLVESGGGLVKPGGSLKLSCAASGYTFTSYVMHWVRQAPGKGLEWIGYINPYNDGTKYNEKFQGRVTISSDKSISTAYMELSSLRSEDTAMYYCARGTYYGTRVFDYWGQG
TLVTVSSASTKGPSVFPLAPSSKSTSGGTAALGCLVKDYFPEPVTVSWNSGALTSGVHTFPAVLQSSGLYSLSSVVTVPSSSLGTQTYTCNVDHKPSNTKVDKKVEPKSCDKTHTCP
PCPAPELLGGPSVFLFPPKPKDTLMISRTPEVTCVVVDVSHEDPEVQFNWYVDGVEVHNAKTKPREEQYNSTYRVVSVLTVLHQDWLNGKEYKCKVSNKALPAPIEKTISKAKGQ
PREPQVYTLPPSQEEMTKNQVSLTCLVKGFYPSDIAVEWESSGQPENNYNTTPPMLDSDGSFFLYSKLTVDKSRWQEGNVFSCSVMHEALHNHYTQKSLSLSPG

Heavy Chain 2 of anti-CD19 x anti-CD3 mAb-scFv [HC ISO(+RR) (scFv)] (SEQ ID NO: 114)

EVQLVESGGGLVKPGGSLKLSCAASGYTFTSYVMHWVRQAPGKGLEWIGYINPYNDGTKYNEKFQGRVTISSDKSISTAYMELSSLRSEDTAMYYCARGTYYGTRVFDYWGQG
TLVTVSSASTKGPSVFPLAPSSKSTSGGTAALGCLVKDYFPEPVTVSWNSGALTSGVHTFPAVLQSSGLYSLSSVVTVPSSSLGTKTYTCNVNHKPSNTKVDKKVERKSCDKTHTCP
RCPAPELLGGPSVFLFPPKPKDTLMISRTPEVTCVVVDVSHEDPEVKFKWYVDGVEVHNAKTKPREEQYNSTYRVVSVLTVLHQDWLNGKEYKCKVSNKALPAPIEKTISKAKGQ
PREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPKGKGGGSGGG
GSEVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVS
WFAYWGQGTLVTVSSGGGGSGGGGSGGGGSQAVTQEPSLTVSPGGTVTLTCGSSTGAVTTSNYANWVQQKPGQAPRGLIGGTNKRAPGVPARFSGSLLGGKAALTLSGAQ
PEDEAEYYCALWYSNLWVFGGGTKLTVL

Figure 70 (continued)

Light Chain of anti-CD19 x anti-CD3 mAb-scFv (SEQ ID NO: 115)

DIVMTQSPATLSLSPGERATLSCRSSKSLQNVNGNTYLYWFQQKPGQSPQLLIYRMSNLNSGVPDRFSGSGSGTEFTLTISSLEPEDFAVYYCMQHLEYPITFGAGTKLEIKRTVAA
PSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

ISO(-)/ISO(-) Homodimer          pI = 6.6

ISO(-)/ISO(+RR) Heterodimer      pI = 8.2

ISO(+RR)/ISO(+RR) Homodimer      pI = 8.7

Figure 71

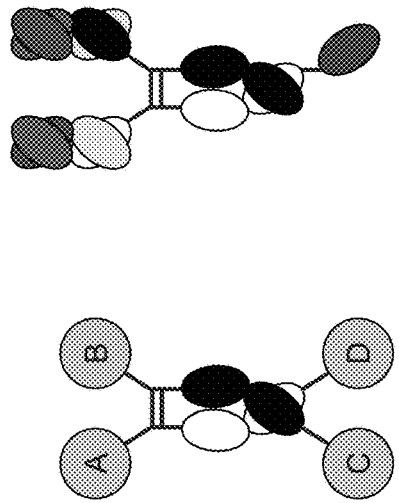

where:
A = Fab
B = Fab
C = n.a.
D = dAb (e.g., $VH_B$ or $VL_B$)

Heavy Chain 1 of anti-CD19 x anti-CD3 mAb-dAb [HC ISO(-)](SEQ ID NO: 116)

EVQLVESGGGLVKPGGSLKLSCAASGYTFTSYVMHWVRQAPGKGLEWIGYINPYNDGTKYNEKFQGRVTISSDKSISTAYMELSSLRSEDTAMYYCARGTYYYGTRVFDYWGQG
TLVTVSSASTKGPSVFPLAPSSKSTSGGTAALGCLVKDYFPEPVTVSWNSGALTSGVHTFPAVLQSSGLYSLSSVVTVPSSSLGTQTYTCNVDHKPSNTKVDKKVEPKSCDKTHTCP
PCPAPELLGGPSVFLFPPKPKDTLMISRTPEVTCVVVDVSHEDPEVQFNWYVDGVEVHNAKTKPREEQYNSTYRVVSVLTVLHQDWLNGKEYKCKVSNKALPAPIEKTISKAKGQ
PREPQVYTLPPSQEEMTKNQVSLTCLVKGFYPSDIAVEWESSGQPENNYNTTPPMLDSDGSFFLYSKLTVDKSRWQEGNVFSCSVMHEALHNHYTQKSLSLSPG

Heavy Chain 2 of anti-CD19 x anti-CD3 mAb-dAb [ISO(+RR] (scFv)] (SEQ ID NO: 117)

EVQLVESGGGLVKPGGSLKLSCAASGYTFTSYVMHWVRQAPGKGLEWIGYINPYNDGTKYNEKFQGRVTISSDKSISTAYMELSSLRSEDTAMYYCARGTYYYGTRVFDYWGQG
TLVTVSSASTKGPSVFPLAPSSKSTSGGTAALGCLVKDYFPEPVTVSWNSGALTSGVHTFPAVLQSSGLYSLSSVVTVPSSSLGTKTYTCNVNHKPSNTKVDKKVERKSCDKTHTCP
RCPAPELLGGPSVFLFPPKPKDTLMISRTPEVTCVVVDVSHEDPEVKFKWYYDGVEVHNAKTKPREEQYNSTYRVVSVLTVLHQDWLNGKEYKCKVSNKALPAPIEKTISKAKGQ
PREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGSGGG
GSEVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVS
WFAYWGQGTLVTVSS

Figure 71 (continued)

Light Chain of anti-CD19 x anti-CD3 mAb-dAb (SEQ ID NO: 118)

DIVMTQSPATLSLSPGERATLSCRSSKSLQNVNGNTYLYWFQQKPGQSPQLLIYRMSNLNSGVPDRFSGSGSGTEFTLTISSLEPEDFAVYYCMQHLEYPITFGAGTKLEIKRTVAA
PSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

ISO(-)/ISO(-) Homodimer        pI = 6.6

ISO(-)/ISO(+RR) Heterodimer    pI = 8.1

ISO(+RR)/ISO(+RR) Homodimer    pI = 8.6

Figure 72

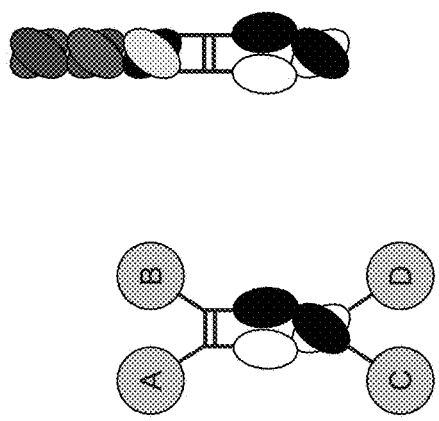

where:
A = $VL_A-VL_B-CL$
B = $VH_A-VH_B-CH1$
C = n.a.
D = n.a.

Heavy Chain 1 of anti-CD19 x anti-CD3 Fv-Fab-Fc [HC ISO(-)] (VL-VL-CL)] (SEQ ID NO: 119)

DIVMTQSPATLSLSPGERATLSCRSSKSLQNVNGNTYLYWFQQKPGQSPQLLIYRMSNLNSGVPDRFSGSGSGTEFTLTISSLEPEDFAVYYCMQHLEYPITFGAGTKLEIKTVAAP SVFIFPPQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLT VLRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECDKTHTCP PCPAPELLGGPSVFLFPPKPKDTLMISRTPEVTCVVVDVSHEDPEVQFNWYVDGVEVHNAKTKPREEQYNSTYRVVSVLTVLHQDWLNGKEYKCKVSNKALPAPIEKTISKAKGQ PREPQVYTLPPSQEEMTKNQVSLTCLVKGFYPSDIAVEWESSGQPENNYNTTPPMLDSDGSFFLYSKLTVDKSRWQEGNVFSCSVMHEALHNHYTQKSLSLSPG

Figure 72 (continued)

Heavy Chain 2 of anti-CD19 x anti-CD3 Fv-Fab-Fc [HC ISO(+RR) (VH-VH-CH1)] (SEQ ID NO:120)

EVQLVESGGGLVKPGGSLKLSCAASGYTFTSYVMHWVRQAPGKGLEWIGYINPYNDGTKYNEKFQGRVTISSDKSISTAYMELSSLRSEDTAMYYCARGTYYYGTRVFDYWGQG
TLVTVSSASTKGPSVFPLAPEVQLVESGGGLVQPGGSLRLSCAASGFTFNTYAMNWVRQAPGKGLEWVGRIRSKYNNYATYYADSVKGRFTISRDDSKNTLYLQMNSLRAEDTA
VYYCVRHGNFGNSYVSWFAYWGQGTLVTVSSASTKGPSVFPLAPSSKSTSGGTAALGCLVKDYFPEPVTVSWNSGALTSGVHTFPAVLQSSGLYSLSSVVTVPSSSLGTKTYTCNV
NHKPSNTKVDKKVERKSSDKTHTCPRCPAPELLGGPSVFLFPPKPKDTLMISRTPEVTCVVVDVSHEDPEVKFKWYVDGVEVHNAKTKPREEQYNSTYRVVSVLTVLHQDWLNG
KEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEA
LHNHYTQKSLSLSPGK

ISO(-)/ISO(-) Homodimer         pI = 6.1

ISO(-)/ISO(+RR) Heterodimer      pI = 8.4

ISO(+RR)/ISO(+RR) Homodimer    pI = 9.0

Figure 73

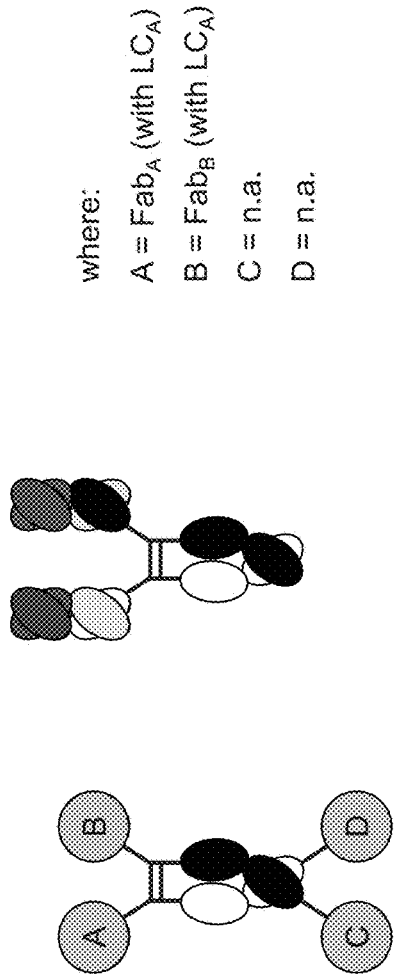

where:
A = Fab$_A$ (with LC$_A$)
B = Fab$_B$ (with LC$_A$)
C = n.a.
D = n.a.

Heavy Chain 1 of anti-CD19 x anti-CD3 common light chain mAb [HC ISO(-) (anti-CD19 Fab with anti-CD19 VH-CH1/anti-CD3 LC)] (SEQ ID NO:121)

EVQLVESGGGLVKPGGSLKLSCAASGYTFTSYVMHWVRQAPGKGLEWIGYINPYNDGTKYNEKFQGRVTISSDKSISTAYMELSSLRSEDTAMYYCARGTYYYGTRVFDYWGQG
TLVTVSSASTKGPSVFPLAPSSKSTSGGTAALGCLVKDYFPEPVTVSWNSGALTSGVHTFPAVLQSSGLYSLSSVVTVPSSSLGTQTYTCNVDHKPSNTKVDKKVEPKSCDKTHTCP
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQ
PREPQVYTLPPSQEEMTKNQVSLTCLVKGFYPSDIAVEWESSNGQPENNYNTTPPMLDSDGSFFLYSKLTVDKSRWQEGNVFSCSVMHEALHNHYTQKSLSLSPG

Heavy Chain 2 of anti-CD19 x anti-CD3 common light chain mAb ISO(+RR) [anti-CD3 Fab with anti-CD3 VH-CH1/anti-CD3 LC)] (SEQ ID NO: 122)

EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWF
AYWGQGTLVTVSSASTKGPSVFPLAPSSKSTSGGTAALGCLVKDYFPEPVTVSWNSGALTSGVHTFPAVLQSSGLYSLSSVVTVPSSSLGTYTCNVNHKPSNTKVDKKVERKSC
DKTHTCPRCPAPELLGGPSVFLFPPKPKDTLMISRTPEVTCVVVDVSHEDPEVKFKWYVDGVEVHNAKTKPREEQYNSTYRVVSVLTVLHQDWLNGKEYKCKVSNKALPAPIEKTI
SKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

Figure 73 (continued)

Light Chain of anti-CD19 x anti-CD3 common light chain mAb (SEQ ID NO: 123)

QAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVLRTVA
APSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

ISO(-)/ISO(-) Homodimer    pI = 7.3

ISO(-)/ISO(+RR) Heterodimer    pI = 8.4

ISO(+RR)/ISO(+RR) Homodimer    pI = 8.8

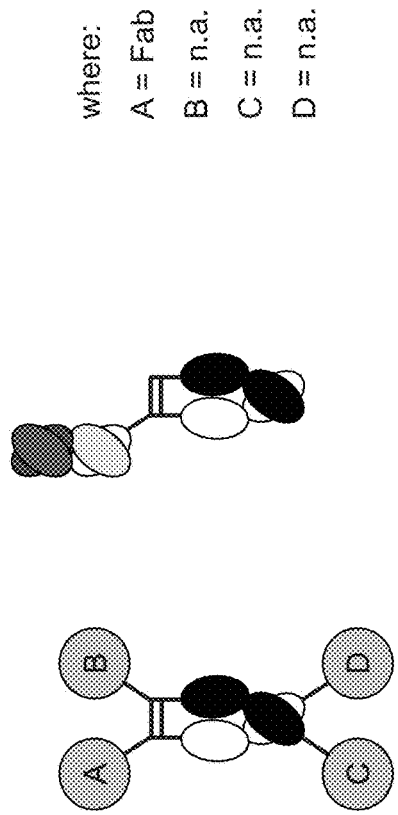

Figure 74 where:
A = Fab
B = n.a.
C = n.a.
D = n.a.

Heavy Chain 1 of anti-CD3 one-arm mAb [HC ISO(-)] (SEQ ID NO: 124)

EPKSSDKTHTCPPCPAPELLGGPSVFLFPPKPKDTLMISRTPEVTCVVVDVSHEDPEVQFNWYVDGVEVHNAKTKPREEQYNSTYRVVSVLTVLHQDWLNGKEYKCKVSNKALP
APIEKTISKAKGQPREPQVYTLPPSQEEMTKNQVSLTCLVKGFYPSDIAVEWESSGQPENNYNTTPPMLDSDGSFFLYSKLTVDKSRWQEGNVFSCSVMHEALHNHYTQKSLSLS
PG

Heavy Chain 2 of anti-CD3 one-arm mAb [HC ISO(+RR) (anti-CD3 Fab)] (SEQ ID NO: 125)

EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWF
AYWGQGTLVTVSSASTKGPSVFPLAPSSKSTSGGTAALGCLVKDYFPEPVTVSWNSGALTSGVHTFPAVLQSSGLYSLSSVVTVPSSSLGTKTYTCNVNHKPSNTKVDKKVERKSC
DKTHTCPRCPAPELLGGPSVFLFPPKPKDTLMISRTPEVTCVVVDVSHEDPEVKFKWYVDGVEVHNAKTKPREEQYNSTYRVVSVLTVLHQDWLNGKEYKCKVSNKALPAPIEKTI
SKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

Figure 74 (continued)

Light Chain of anti-CD3 one-arm mAb (SEQ ID NO: 126)

QAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVLRTVA
APSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

ISO(-)/ISO(-) Homodimer          pI = 6.2

ISO(-)/ISO(+RR) Heterodimer      pI = 8.3

ISO(+RR)/ISO(+RR) Homodimer      pI = 8.8

Figure 75

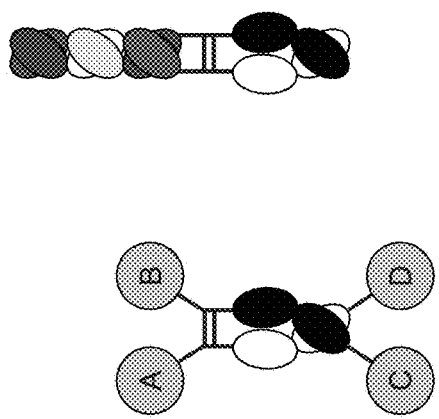

where:
A = VH$_A$-CH1-VH$_B$
B = VL$_A$-CL-VL$_B$
C = n.a.
D = n.a.

Heavy Chain 1 of anti-CD19 x anti-CD3 Fab-Fv-Fc [HC ISO(-)] (VL-CL-VL)] (SEQ ID NO: 127)

DIVMTQSPATLSLSPGERATLSCRSSKSLQNVNGNTYLYWFQQKPGQSPQLLIYRMSNLNSGVPDRFSGSGSGTEFTLTISSLEPEDFAVYYCMQHLEYPITFGAGTKLEIKRTVAA
PSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECTVAAPSVFIFPPQAV
VTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVLEPKSSDKT
HTCPPCPAPELLGGPSVFLFPPKPKDTLMISRTPEVTCVVVDVSHEDPEVQFNWYVDGVEVHNAKTKPREEQYNSTYRVVSVLTVLHQDWLNGKEYKCKVSNKALPAPIEKTISK
AKGQPREPQVYTLPPSQEEMTKNQVSLTCLVKGFYPSDIAVEWESSGQPENNYNTTPPMLDSDGSFFLYSKLTVDKSRWQEGNVFSCSVMHEALHNHYTQKSLSLSPG

Figure 75 (continued)

Heavy Chain 2 of anti-CD19 x anti-CD3 Fab-Fv-Fc [HC ISO(+RR) (VH-CH1-VH)] (SEQ ID NO:128)

EVQLVESGGGLVKPGGSLKLSCAASGYTFTSYVMHWVRQAPGKGLEWIGYINPYNDGTKYNEKFQGRVTISSDKSISTAYMELSSLRSEDTAMYYCARGTYYYGTRVFDYWGQG
TLVTVSSASTKGPSVFPLAPSSKSTSGGTAALGCLVKDYFPEPVTVSWNSGALTSGVHTFPAVLQSSGLYSLSSVVTVPSSSLGTKTYTCNVNHKPSNTKVDKKVERKSCASTKGPSV
FPLAPEVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSY
VSWFAYWGQGTLVTVSSERKSSDKTHTCPRCPAPELLGGPSVFLFPPKPKDTLMISRTPEVTCVVVDVSHEDPEVKFKWYVDGVEVHNAKTKPREEQYNSTYRVVSVLTVLHQD
WLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSV
MHEALHNHYTQKSLSLSPGK

ISO(-)/ISO(-) Homodimer          pI = 6.1

ISO(-)/ISO(+RR) Heterodimer      pI = 8.4

ISO(+RR)/ISO(+RR) Homodimer      pI = 9.0

Figure 76

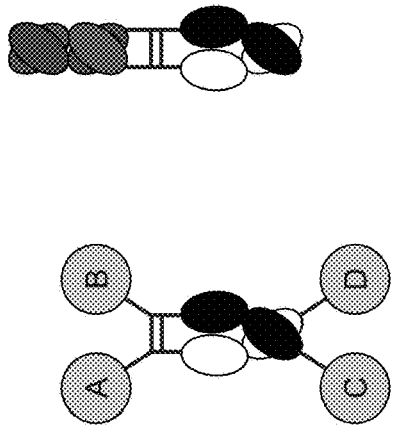

where:
A = VH$_A$-VH$_B$
B = VL$_A$-VL$_B$
C = n.a.
D = n.a.

Heavy Chain 1 of anti-CD19 x anti-CD3 Fv-Fv-Fc [HC ISO(-) (VL-VL)] (SEQ ID NO: 129)

DIVMTQSPATLSLSPGERATLSCRSSKSLQNVNGNTYLYWFQQKPGQSPQLLIYRMSNLNSGVPDRFSGSGSGTEFTLTISSLEPEDFAVYYCMQHLEYPITFGAGTKLEIKTVAAP
SVFIFPPQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLT
VLEPKSSDKTHTCPPCPAPELLGGPSVFLFPPKPKDTLMISRTPEVTCVVVDVSHEDPEVQFNWYVDGVEVHNAKTKPREEQYNSTYRVVSVLTVLHQDWLNGKEYKCKVSNKAL
PAPIEKTISKAKGQPREPQVYTLPPSQEEMTKNQVSLTCLVKGFYPSDIAVEWESSGQPENNYNTTPPMLDSDGSFFLYSKLTVDKSRWQEGNVFSCSVMHEALHNHYTQKSLSL
SPG

Figure 76 (continued)

Heavy Chain 2 of anti-CD19 x anti-CD3 Fv-Fv-Fc [HC ISO(+RR) (VH-VH)] (SEQ ID NO:130)

EVQLVESGGGLVKPGGSLKLSCAASGYTFTSYVMHWVRQAPGKGLEWIGYINPYNDGTKYNEKFQGRVTISSDKSISTAYMELSSLRSEDTAMYYCARGTYYGTRVFDYWGQG
TLVTVSSASTKGPSVFPLAPEVQLVESGGGLVQPGGSLRLSCAASGFTFNTYAMNWVRQAPGKGLEWVGRIRSKYNNYATYYADSVKGRFTISRDDSKNTLYLQMNSLRAEDTA
VYYCVRHGNFGNSYVSWFAYWGQGTLVTVSSERKSSDKTHTCPRCPAPELLGGPSVFLPPKPKDTLMISRTPEVTCVVVDVSHEDPEVKFKWYVDGVEVHNAKTKPREEQYNS
TYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDK
SRWQQGNVFSCSVMHEALHNHYTQKSLSLSPGK

ISO(-)/ISO(-) Homodimer         pI = 6.1

ISO(-)/ISO(+RR) Heterodimer     pI = 8.2

ISO(+RR)/ISO(+RR) Homodimer     pI = 8.8

Figure 77

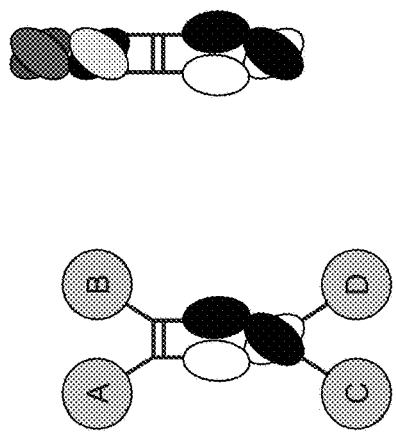

where:
A = VH-CH1
B = VL-CL
C = n.a.
D = n.a.

Heavy Chain 1 of anti-CD3 monovalent mAb [HC ISO(-) (VL-CL)] (SEQ ID NO: 131)

QAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVLRTVA
APSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECDKTHTCPPCPAPE
LLGGPSVFLFPPKPKDTLMISRTPEVTCVVVDVSHEDPEVQFNWYVDGVEVHNAKTKPREEQYNSTYRVVSVLTVLHQDWLNGKEYKCKVSNKALPAPIEKTISKAKGQPREPQV
YTLPPSQEEMTKNQVSLTCLVKGFYPSDIAVEWESSGQPENNYNTTPPMLDSDGSFFLYSKLTVDKSRWQEGNVFSCSVMHEALHNHYTQKSLSLSPG

Figure 77 (continued)

Heavy Chain 2 of anti-CD3 monovalent mAb [HC ISO(+RR) (VH-CH1)] (SEQ ID NO: 132)

EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWF
AYWGQGTLVTVSSASTKGPSVFPLAPSSKSTSGGTAALGCLVKDYFPEPVTVSWNSGALTSGVHTFPAVLQSSGLYSLSSVVTVPSSSLGTKTYTCNVNHKPSNTKVDKKVERKSC
DKTHTCPRCPAPELLGGPSVFLFPPKPKDTLMISRTPEVTCVVVDVSHEDPEVKFKWYVDGVEVHNAKTKPREEQYNSTYRVVSVLTVLHQDWLNGKEYKCKVSNKALPAPIEKTI
SKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

ISO(-)/ISO(-) Homodimer     pI = 6.2

ISO(-)/ISO(+RR) Heterodimer     pI = 8.4

ISO(+RR)/ISO(+RR) Homodimer     pI = 9.0

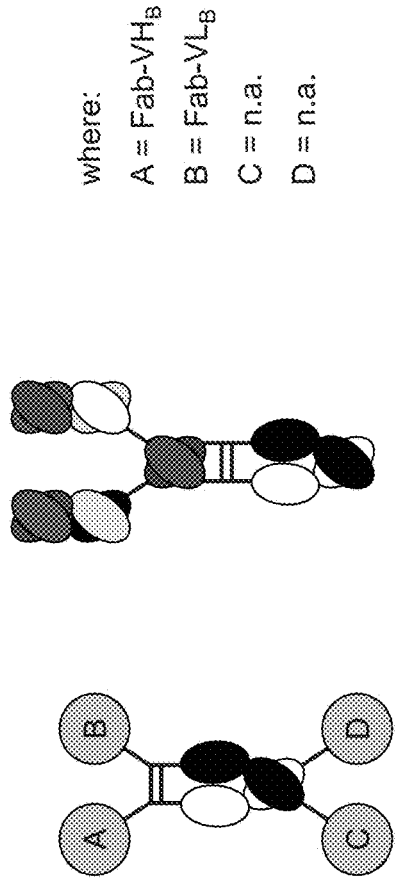

Figure 78 where:
A = Fab-VH$_B$
B = Fab-VL$_B$
C = n.a.
D = n.a.

Heavy Chain 1 of anti-CD19 x anti-CD3 central Fv [HC ISO(-) (Fab-VH)] (SEQ ID NO: 133)

EVQLVESGGGLVKPGGSLKLSCAASGYTFTSYVMHWVRQAPGKGLEWIGYINPYNDGTKYNEKFQGRVTISSDKSISTAYMELSSLRSEDTAMYYCARGTYYYGTRVFDYWGQG
TLVTVSSASTKGPSVFPLAPSSKSTSGGTAALGCLVKDYFPEPVTVSWNSGALTSGVHTFPAVLQSSGLYSLSSVVTVPSSSLGTQTYTCNVDHKPSNTKVDKKVEPKSCASTKGPS
VFPLAPEVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNS
YVSWFAYWGQGTLVTVSSEPKSSDKTHTCPPCPAPELLGGPSVFLFPPKPKDTLMISRTPEVTCVVVDVSHEDPEVQFNWYVDGVEVHNAKTKPREEQYNSTYRVVSVLTVLHQ
DWLNGKEYKCKVSNKALPAPIEKTISKAKGQPREPQVYTLPPSQEEMTKNQVSLTCLVKGFYPSDIAVEWESSGQPENNYKTTPPMLDSDGSFFLYSKLTVDKSRWQEGNVFSCS
VMHEALHNHYTQKSLSLSPG

Heavy Chain 2 of anti-CD19 x anti-CD3 central Fv [HC ISO(+RR) (Fab-VL)] (SEQ ID NO: 134)

EVQLVESGGGLVKPGGSLKLSCAASGYTFTSYVMHWVRQAPGKGLEWIGYINPYNDGTKYNEKFQGRVTISSDKSISTAYMELSSLRSEDTAMYYCARGTYYYGTRVFDYWGQG
TLVTVSSASTKGPSVFPLAPSSKSTSGGTAALGCLVKDYFPEPVTVSWNSGALTSGVHTFPAVLQSSGLYSLSSVVTVPSSSLGTKTYTCNVNHKPSNTKVDKKVEPKSCTVAAPSVF
IFPPQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVLE
RKSSDKTHTCPRCPAPELLGGPSVFLFPPKPKDTLMISRTPEVTCVVVDVSHEDPEVKFKWYVDGVEVHNAKTKPREEQYNSTYRVVSVLTVLHQDWLNGKEYKCKVSNKALPAP
IEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG
K

Figure 78 (continued)

Light Chain of anti-CD19 x anti-CD3 central Fv (SEQ ID NO:135)

DIVMTQSPATLSLSPGERATLSCRSSKSLQNVNGNTYLYWFQQKPGQSPQLLIYRMSNLNSGVPDRFSGSGSGTEFTLTISSLEPEDFAVYYCMQHLEYPITFGAGTKLEIKRTVAA
PSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

ISO(-)/ISO(-) Homodimer       pI = 7.8

ISO(-)/ISO(+RR) Heterodimer   pI = 8.3

ISO(+RR)/ISO(+RR) Homodimer   pI = 8.5

Figure 79

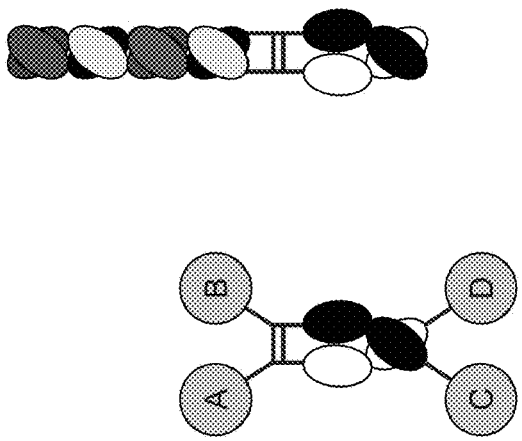

where:
A = VL$_A$-CL-VL$_B$-CL
B = VH$_A$-CH1-VH$_B$-CH1
C = n.a.
D = n.a.

Heavy Chain 1 of anti-CD19 x anti-CD3 Fab-Fab-Fc [HC ISO(-) (VL-CL-VL-CL)] (SEQ ID NO: 136)

DIVMTQSPATLSLSPGERATLSCRSSKSLQNVNGNTYLYWFQQKPGQSPQLLIYRMSNLNSGVPDRFSGSGSGTEFTLTISSLEPEDFAVYYCMQHLEYPITFGAGTKLEIKRTVAA
PSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECTVAAPSVFIFPPQAV
VTQEPSLTVSPGGTVTLTCGSSTGAVTTSNYANWVQQKPGQAPRGLIGGTNKRAPGVPARFSGSILLGGKAALTLSGAQPEDEAEYYCALWYSNLWVFGGGTKLTVLRTVAAPS
VFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECDKTHTCPPCPAPELLG
GPSVFLFPPKPKDTLMISRTPEVTCVVVDVSHEDPEVQFNWYVDGVEVHNAKTKPREEQYNSTYRVVSVLTVLHQDWLNGKEYKCKVSNKALPAPIEKTISKAKGQPREPQVYTL
PPSQEEMTKNQVSLTCLVKGFYPSDIAVEWESSGQPENNYNTTPPMLDSDGSFFLYSKLTVDKSRWQEGNVFSCSVMHEALHNHYTQKSLSLSPG

Figure 79 (continued)

Heavy Chain 2 of anti-CD19 x anti-CD3 Fab-Fab-Fc [HC ISO(+RR) (VH-CH1-VH-CH1)] (SEQ ID NO: 137)

EVQLVESGGGLVKPGGSLKLSCAASGYTFTSYVMHWVRQAPGKGLEWIGYINPYNDGTKYNEKFQGRVTISSDKSISTAYMELSSLRSEDTAMYYCARGTYYYGTRVFDYWGQG
TLVTVSSASTKGPSVFPLAPSSKSTSGGTAALGCLVKDYFPEPVTVSWNSGALTSGVHTFPAVLQSSGLYSLSSVVTVPSSSLGTKTYTCNVNHKPSNTKVDKKVERKSCASTKGPSV
FPLAPEVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSY
VSWFAYWGQGTLVTVSSASTKGPSVFPLAPSSKSTSGGTAALGCLVKDYFPEPVTVSWNSGALTSGVHTFPAVLQSSGLYSLSSVVTVPSSSLGTKTYTCNVNHKPSNTKVDKKVE
RKSCDKTHTCPRCPAPELLGGPSVFLFPPKPKDTLMISRTPEVTCVVVDVSHEDPEVKFKWYVDGVEVHNAKTKPREEQYNSTYRVVSVLTVLHQDWLNGKEYKCKVSNKALPAP
IEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG
K

ISO(-)/ISO(-) Homodimer        pI = 6.1

ISO(-)/ISO(+RR) Heterodimer    pI = 8.5

ISO(+RR)/ISO(+RR) Homodimer    pI = 9.1

Figure 80

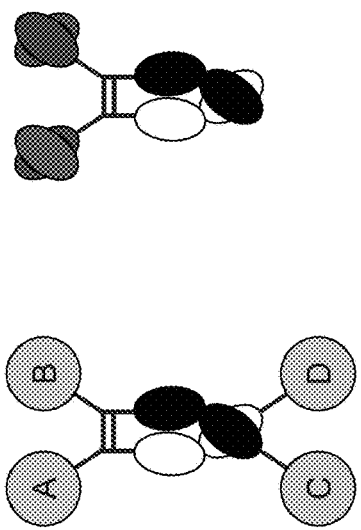

where:
A = anti-CD19 scFv (anti-CD19 VH-(Gly4Ser)3-anti-CD19 VL)
B = anti-CD3 scFv (anti-CD3 VH-(Gly4Ser)3-anti-CD3 VL)
C = n.a.
D = n.a.

Heavy Chain 1 of XENP11355 anti-CD19 x anti-CD3 dual scFv-Fc [HC ISO(-) (anti-CD19 scFv)] (SEQ ID NO: 138)

EVQLVESGGGLVKPGGSLKLSCAASGYTFTSYVMHWVRQAPGKGLEWIGYINPYNDGTKYNEKFQGRVTISSDKSISTAYMELSSLRSEDTAMYYCARGTYYYGTRVFDYWGQG
TLVTVSSGGGGSGGGGSGGGGSDIVMTQSPATLSLSPGERATLSCRSSKSLQNVNGNTYLYWFQQKPGQSPQLLIYRMSNLNSGVPDRFSGSGSGTEFTLTISSLEPEDFAVYYC
MQHLEYPITFGAGTKLEIKEPKSSDKTHTCPPCPAPELLRGPSVFLFPPKPKDTLMISRTPEVTCVVVDVSHEDPEVQFNWYVDGVEVHNAKTKPREEQYNSTYRVVSVLTVLHQD
WLNGKEYKCKVSNKARPAPIEKTISKAKGQPREPQVYTLPPSQEEMTKNQVSLTCLVKGFYPSDIAVEWESSGQPENNYNTTPPMLDSDGSFFLYSKLTVDKSRWQEGNVFSCSV
MHEALHNHYTQKSLSLSPG

Figure 80 (continued)

Heavy Chain 2 of XENP11355 anti-CD19 x anti-CD3 dual scFv-Fc [HC ISO(+RR) (anti-CD3 scFv)] (SEQ ID NO:139)

EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYYSWF
AYWGQGTLVTVSSGGGGSGGGGSGGGGSQAVVTQEPSLTVSPGGTVTLTCGSSTGAVTSNYANWVQQKPGQAPRGLIGGTNKRAPGVPARFSGSLLGGKAALTLSGAQPE
DEAEYYCALWYSNLWVFGGGTKLTVLERKSSDKTHTCPRCPAPELLRGPSVFLFPPKPKDTLMISRTPEVTCVVVDVSHEDPEVKFKWYVDGVEVHNAKTKPREEQYNSTYRVVS
VLTVLHQDWLNGKEYKCKVSNKARPAPIEKTISKAKGQPREPQVYTLPPSREEMTKNQVSLTCLVKGFYPSDIAVEWESNGQPENNYKTTPPVLDSDGSFFLYSKLTVDKSRWQQ
GNVFSCSVMHEALHNHYTQKSLSLSPGK

ISO(-)/ISO(-) Homodimer          pI = 6.4

ISO(-)/ISO(+RR) Heterodimer      pI = 8.4

ISO(+RR)/ISO(+RR) Homodimer      pI = 9.0

Figure 82

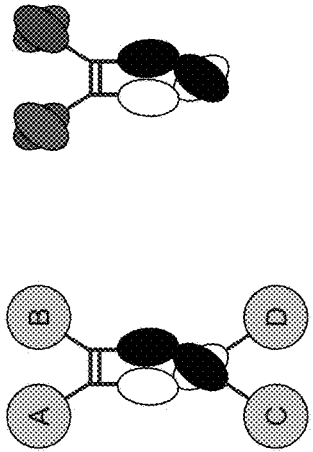

where:
A = anti-CD32b scFv (anti-CD32b VH-(Gly$_4$Ser)$_4$-anti-CD32b VL)
B = anti-CD19 scFv (anti-CD19 VH-(Gly$_4$Ser)$_4$-anti-CD19 VL)
C = n.a.
D = n.a.

Heavy Chain 1 of XENP11139 anti-CD19 x anti-CD32b dual scFv-Fc [HC ISO(-)] (anti-CD32b scFv)] (SEQ ID NO: 140)

EVQLVESGGGLVSPGGSLKLSCVASGFAFSSYDMSWVRQTPEKRLEWVAKINSAGGRTNYPDTVKGRFTISRDNAENTLYLQMSSLKSEDTAMYYCAGHSYDYPFTYWGQGTL
VTVSAGGGGSGGGGSGGGGSGGGGSDVVLTQSPATLSVTPGDSVSLSCRASQSISGIPSRFSGSGSGTDFTLSINSVETEDFGMYFCCQQ
SDSWPHTFGGGTKLEIKEPKSSDKTHTCPPCPAPELLGGPSVFLFPPKPKDTLMISRTPEVTCVVVDVSHEDPEVQFNWYVDGVEVHNAKTPREEQYNSTYRVVSVLTVLHQD
WLNGKEYKCKVSNKARPAPIEKTISKAKGQPREPQVYTLPPSQEEMTKNQVSLTCLVKGFYPSDIAVEWESSGQPENNYNTTPPMLDSDGSFFLYSKLTVDKSRWQEGNVFSCSV
MHEALHNHYTQKSLSLSPG

Heavy Chain 2 of XENP11139 anti-CD19 x anti-CD32b dual scFv-Fc [HC ISO(+)] (anti-CD19 scFv)] (SEQ ID NO: 141)

EVQLVESGGGLVKPGGSLKLSCAASGYTFTSYVMHWVRQAPGKGLEWIGYINPYNDGTKYNEKFQGRVTISSDKSISTAYMELSSLRSEDTAMYYCARGTYYYGTRVFDYWGQG
TLVTVSSGGGGSGGGGSGGGGSGGGGSDIVMTQSPATLSLSPGERATLSCRSSKSLQNVNGNTYLYWFQQKPGQSPQLLIYRMSNLNSGVPDRFSGSGSGTEFTLTISSLEPEDF
AVYYCMQHLEYPITFGAGTKLEIKEPKSSDKTHTCPPCPAPELLRGPSVFLFPPKPKDTLMISRTPEVTCVVVDVSHEDPEVKFKWYVDGVEVHNAKTKPREEQYNSTYRVVSVLTV
LHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQQGNV
FSCSVMHEALHNHYTQKSLSLSPGK

ISO(-)/ISO(-) Homodimer    pI = 6.0
ISO(-)/ISO(+) Heterodimer  pI = 6.8
ISO(+)/ISO(+) Homodimer    pI = 8.2

Figure 84

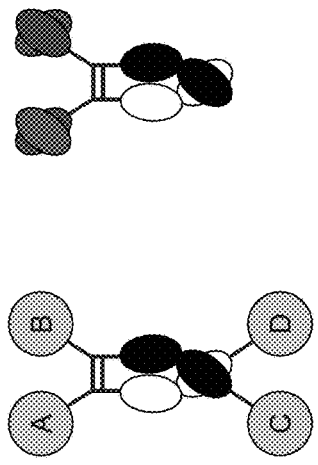

where:
A = anti-CD19 scFv (anti-CD19 VH-(Gly₄Ser)₃-anti-CD19 VL)
B = anti-CD3 scFv (anti-CD3 VH-(Gly₄Ser)₃-anti-CD3 VL)
C = n.a.
D = n.a.

Heavy Chain 1 of XENP11338 anti-CD19 x anti-CD3 dual scFv-Fc [HC ISO(-)] (anti-CD19 scFv)] (SEQ ID NO:142)

EVQLVESGGGLVKPGGSLKLSCAASGYTFTSYVMHWVRQAPGKGLEWIGYINPYNDGTKYNEKFQGRVTISSDKSISTAYMELSSLRSEDTAMYYCARGTYYYGTRVFDYWGQG
TLVTVSSGGGGSGGGGSGGGGSGDIVMTQSPATLSLSPGERATLSCRSSKSLQNVNGNTYLYWFQQKPGQSPQLLIYRMSNLNSGVPDRFSGSGSGTEFTLTISSLEPEDFAVYYC
MQHLEYPITFGAGTKLEIKEPKSSDKTHTCPPCPAPELLGGPSVFLFPPKPKDTLMISRTPEVTCVVVDVSHEDPEVQFNWYVDGVEVHNAKTKPREEQYNSTYRVVSVLTVLHQD
WLNGKEYKCKVSNKARPAPIEKTISKAKGQPREPQVYTLPPSQEEMTKNQVSLTCLVKGFYPSDIAVEWESSGQPENNYNTTPPMLDSDGSFFLYSKLTVDKSRWQEGNVFSCSV
MHEALHNHYTQKSLSLSPG

Heavy Chain 2 of XENP11338 anti-CD19 x anti-CD3 dual scFv-Fc [HC ISO(+)] (anti-CD3 scFv)] (SEQ ID NO: 143)

EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWF
AYWGQGTLVTVSSGGGGSGGGGSGGGGSQAVVTQEPSLTVSPGGTVTLTCGSSTGAVTSNYANWVQQKPGQAPRGLIGGTNKRAPGVPARFSGSLLGGKAALTLSGAQPE
DEAEYYCALWYSNLWVFGGGTKLTVLEPKSSDKTHTCPPCPAPELLGGPSVFLFPPKPKDTLMISRTPEVTCVVVDVSHEDPEVKFKWYVDGVEVHNAKTKPREEQYNSTYRVVS
VLTVLHQDWLNGKEYCKCKVSNKARPAPIEKTISKAKGQPREPQVYTLPPSREEMTKNQVSLTCLVKGFYPSDIAVEWESNGQPENNYKTTPPVLDSDGSFFLYSKLTVDKSRWQQ
GNVFSCSVMHEALHNHYTQKSLSLSPGK

ISO(-)/ISO(-) Homodimer    pI = 6.4
ISO(-)/ISO(+) Heterodimer  pI = 8.3
ISO(+)/ISO(+) Homodimer    pI = 8.9

Figure 86

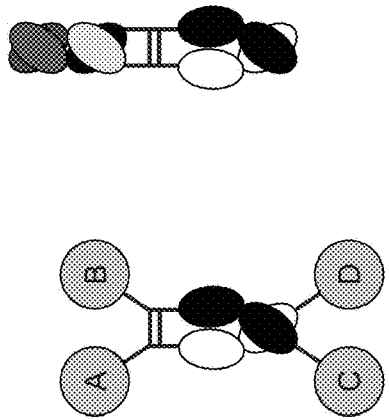

where:
A = anti-CD40 VL-CL
B = anti-CD40 VH-CH1
C = n.a.
D = n.a.

Heavy Chain 1 of XENP11233 anti-CD40 monovalent mAb [HC ISO(-)] (anti-CD40 VL-CL)] (SEQ ID NO: 144)

DAVMTQNPLSLPVSLGDEASISCRSSQSLENSNGNTFLNWFFQKPGQSPQLLIYRVSNRFSGVPDRFSGSGSGTDFTLKISRVEAEDLGVYFCLQVTHVPYTFGGGTTLEIKRTVAA
PSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECDKTHTCPPCPAPELL
RGPSVFLFPPKPKDTLMISRTPEVTCVVVDVSHEDPEVQFNWYVDGVEVHNAKTKPREEQYNSTYRVVSVLTVLHQDWLNGKEYKCKVSNKARPAPIEKTISKAKGQPREPQVY
TLPPSQEEMTKNQVSLTCLVKGFYPSDIAVEWESSGQPENNYNTTPPMLDSDGSFFLYSKLTVDKSRWQEGNVFSCSVMHEALHNHYTQKSLSLSPG

Heavy Chain 2 of XENP11233 anti-CD40 monovalent mAb [HC ISO(+)] (anti-CD40 VH-CH1)] (SEQ ID NO: 145)

DIQLQQSGPGLVKPSQSLSLTCSVTGYSITTNYAWNWIRQFPGNKLEWMGYIRYDGTSEYTPSLKNRVSITRDTSMNQFFLRLTSVTPEDTATYYCARLDYWGQGTSVTVSSAST
KGPSVFPLAPSSKSTSGGTAALGCLVKDYFPEPVTVSWNSGALTSGVHTFPAVLQSSGLYSLSSVVTVPSSSLGTKTYTCNVNHKPSNTKVDKKVEPKSCDKTHTCPPCPAPELLRG
PSVFLFPPKPKDTLMISRTPEVTCVVVDVSHEDPEVKFKWYVDGVEVHNAKTKPREEQYNSTYRVVSVLTVLHQDWLNGKEYKCKVSNKARPAPIEKTISKAKGQPREPQVYTLP
PSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

ISO(-)/ISO(-) Homodimer      pI = 6.0
ISO(-)/ISO(+) Heterodimer    pI = 7.9
ISO(+)/ISO(+) Homodimer      pI = 8.9

Figure 88

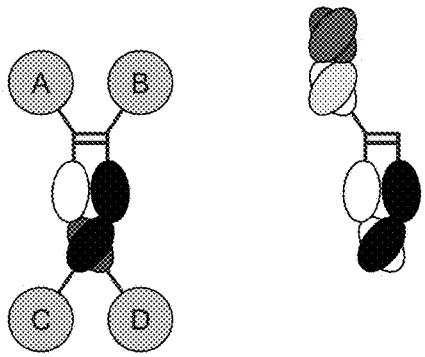

where:
A = anti-CD40 Fab
B = n.a.
C = n.a.
D = n.a.

Heavy Chain 1 of XENP11238 anti-CD40 one-arm mAb [HC ISO(-)](SEQ ID NO: 146)

EPKSSDKTHTCPPCPAPELLRGPSVFLFPPKPKDTLMISRTPEVTCVVVDVSHEDPEVQFNWYVDGVEVHNAKT
KPREEQYNSTYRVVSVLTVLHQDWLNGKEYKCKVSNKARPAPIEKTISKAKGQPREPQVYTLPPSQEEMTKNQV
SLTCLVKGFYPSDIAVEWESSGQPENNYNTTPPMLDSDGSFFLYSKLTVDKSRWQEGNVFSCSVMHEALHNHY
TQKSLSLSPG

Heavy Chain 2 of XENP11238 anti-CD40 one-arm mAb [HC ISO(+) (anti-CD40 Fab)] (SEQ ID NO: 147)

QVKLEESGPGLVAPSQSLSITCTVSGFSLSRYSVYWVRQPPGKGLEWLGMMWGGGSTDYNSALKSRLSISKDT
SKSQVFLKMNSLQTDDTAMYYCVRTDGDYWGQGTSVTVSSASTKGPSVFPLAPSSKSTSGGTAALGCLVKDYF
PEPVTVSWNSGALTSGVHTFPAVLQSSGLYSLSSVVTVPSSSLGTKTYTCNVNHKPSNTKVDKKVEPKSCDKTHT
CPPCPAPELLRGPSVFLFPPKPKDTLMISRTPEVTCVVVDVSHEDPEVKFKWYVDGVEVHNAKTKPREEQYNST
YRVVSVLTVLHQDWLNGKEYKCKVSNKARPAPIEKTISKAKGQPREPQVYTLPPSREEMTKNQVSLTCLVKGFY
PSDIAVEWESNGQPENNYKTTPPVLDSDGSFFLYSKLTVDKSRWQQGNVFSCSVMHEALHNHYTQKSLSLSPG
K

Light Chain of XENP11238 anti-CD40 one-arm mAb [LC (anti-CD40 Fab)] (SEQ ID NO:148)

ELQLTQSPLSLPVSLGDQASISCRSSQSLVNSNGNTYLHWYLQKPGQSPKLLIYKVSNRFSGVPDRFSGSGSGTD
FTLKISRVEAEDLGVYFCSQSTHVPWTFGGGTKLEIKRTVAAPSVFIFPPSDEQLKSGTASVVCLLNNFYPREAKV
QWKVDNALQSGNSQESVTEQDSKDSTYSLSSTLTLSKADYEKHKVYACEVTHQGLSSPVTKSFNRGEC

ISO(-)/ISO(-) Homodimer    pI = 6.2

ISO(-)/ISO(+) Heterodimer  pI = 8.3

ISO(+)/ISO(+) Homodimer    pI = 8.7

Figure 90

| XenP# | pI (calc.) | # KR | Delta KR (vs. WT) | # DE | Delta DE (vs. WT) | Charge State | # HC Mutations vs IgG1 | # LC Mutations vs IgG1 |
|---|---|---|---|---|---|---|---|---|
| XENP004547 | 8.10 | 122 | 0 | 116 | 0 | 6 | | 0 |
| XENP006384 | 7.31 | 118 | -4 | 118 | 2 | 0 | | |
| NA | | | | | | | 27 | 0 |
| NA | | | | | | | 22 | 0 |
| XENP007349 | 8.11 | 120 | -2 | 114 | -2 | 6 | 28 | 0 |
| XENP005653 | 8.1 | 122 | 0 | 116 | 0 | 6 | 11 | 0 |
| XENP006389 | 7.31 | 118 | -4 | 118 | 2 | 0 | 1 | 0 |
| XENP009491 | 6.21 | 116 | -6 | 128 | 12 | -18 | 28 | 0 |
| XENP009492 | 6.21 | 116 | -6 | 128 | 12 | -18 | 6 | 6 |
| XENP009493 | 5.49 | 110 | -12 | 140 | 24 | -30 | 0 | 6 |
| XENP009992 | 5.49 | 110 | -12 | 140 | 24 | -30 | 6 | 6 |
| XENP009993 | 5.49 | 110 | -12 | 140 | 24 | -30 | 7 | 6 |
| XENP010088 | 6.58 | 116 | -6 | 122 | 6 | -6 | 8 | 3 |
| XENP010089 | 5.85 | 116 | -6 | 136 | 20 | -20 | 0 | 10 |
| XENP010090 | 6.16 | 112 | -10 | 124 | 8 | -12 | 0 | 3 |
| XENP010091 | 5.88 | 112 | -10 | 130 | 14 | -18 | 27 | 6 |
| XENP010092 | 5.58 | 112 | -10 | 138 | 22 | -26 | 27 | 10 |
| XENP010093 | 6.20 | 110 | -12 | 122 | 6 | -12 | 27 | 0 |
| XENP010094 | 6.20 | 110 | -12 | 122 | 6 | -12 | 13 | 0 |
| XENP010095 | 6.16 | 110 | -12 | 122 | 6 | -12 | 15 | 0 |
| XENP010096 | 5.63 | 104 | -18 | 128 | 12 | -24 | 19 | 3 |
| XENP010101 | 5.43 | 104 | -18 | 134 | 18 | -30 | 19 | 6 |
| XENP010102 | 5.23 | 104 | -18 | 142 | 26 | -38 | 19 | 10 |
| XENP010103 | 5.79 | 110 | -12 | 130 | 14 | -20 | 22 | 0 |
| XENP010104 | 5.37 | 104 | -18 | 136 | 20 | -32 | 22 | 3 |
| XENP010105 | 5.22 | 104 | -18 | 142 | 26 | -38 | 22 | 6 |
| XENP010106 | 5.07 | 104 | -18 | 150 | 34 | -46 | 22 | 10 |
| XENP010107 | 5.31 | 100 | -18 | 136 | 20 | -38 | 7 | 4 |
| XENP010108 | 4.98 | 92 | -22 | 144 | 28 | -50 | 11 | 4 |
| XENP010109 | 5.36 | 100 | -30 | 134 | 18 | -48 | 17 | 4 |
| XENP010110 | 5.01 | 92 | -22 | 142 | 26 | -48 | 21 | 4 |
| XENP010017 | 6.59 | 122 | 0 | 128 | 12 | -6 | 3 | 3 |

Figure 90 (cont.)

| ID | | | | | | | |
|---|---|---|---|---|---|---|---|
| XENPO10018 | 6.58 | 110 | -12 | 116 | 0 | -6 | 3 | 3 |
| XENPO10019 | 5.92 | 110 | -12 | 128 | 12 | -18 | 3 | 3 |
| XENPO10178 | 6.27 | 110 | -12 | 120 | 4 | -10 | 28 | 0 |
| XENPO10179 | 6.20 | 110 | -12 | 122 | 6 | -12 | 19 | 0 |
| XENPO10180 | 6.27 | 110 | -12 | 120 | 4 | -10 | 29 | 0 |
| XENPO10181 | 6.20 | 110 | -12 | 122 | 6 | -12 | 20 | 4 |
| XENPO10182 | 5.55 | 110 | -12 | 122 | 12 | -26 | 28 | 4 |
| XENPO10183 | 5.54 | 102 | -20 | 128 | 14 | -28 | 19 | 4 |
| XENPO10184 | 5.55 | 102 | -20 | 130 | 12 | -26 | 29 | 4 |
| XENPO10185 | 5.54 | 102 | -20 | 128 | 14 | -28 | 20 | 4 |
| XENPO10265 | 6.31 | 102 | -20 | 130 | 6 | -10 | 18 | 0 |
| XENPO10266 | 6.31 | 112 | -10 | 122 | 6 | -12 | 18 | 0 |
| XENPO10267 | 6.20 | 112 | -10 | 122 | 6 | -12 | 18 | 0 |
| XENPO10268 | 6.20 | 110 | -12 | 122 | 6 | -12 | 18 | 0 |
| XENPO10269 | 6.20 | 110 | -12 | 122 | 6 | -12 | 18 | 0 |
| XENPO10270 | 6.20 | 110 | -12 | 122 | 6 | -10 | 18 | 0 |
| XENPO10271 | 6.31 | 112 | -10 | 122 | 6 | -12 | 18 | 0 |
| XENPO10272 | 6.20 | 110 | -12 | 122 | 6 | -10 | 18 | 0 |
| XENPO10273 | 6.31 | 112 | -10 | 122 | 6 | -12 | 18 | 0 |
| XENPO10274 | 6.20 | 110 | -12 | 122 | 6 | -12 | 18 | 0 |
| XENPO10275 | 6.20 | 110 | -12 | 120 | 4 | -10 | 18 | 0 |
| XENPO10276 | 6.31 | 110 | -12 | 122 | 6 | -12 | 17 | 0 |
| XENPO10277 | 6.31 | 112 | -10 | 122 | 6 | -10 | 16 | 0 |
| XENPO10278 | 6.20 | 110 | -12 | 120 | 4 | -10 | 18 | 0 |
| XENPO10279 | 6.20 | 110 | -12 | 122 | 6 | -12 | 18 | 0 |
| XENPO10280 | 6.20 | 110 | -12 | 122 | 6 | -12 | 18 | 0 |
| XENPO10281 | 6.20 | 110 | -12 | 120 | 4 | -10 | 18 | 0 |
| XENPO10282 | 6.20 | 110 | -12 | 122 | 6 | -10 | 18 | 0 |
| XENPO10283 | 6.31 | 110 | -12 | 120 | 4 | -10 | 18 | 0 |
| XENPO10284 | 6.31 | 112 | -10 | 122 | 6 | -12 | 18 | 0 |
| XENPO10285 | 6.31 | 110 | -12 | 120 | 4 | -10 | 17 | 0 |
| XENPO10286 | 6.20 | 110 | -12 | 122 | 6 | -12 | 17 | 0 |
| XENPO10287 | 6.31 | 110 | -12 | 120 | 4 | -10 | 17 | 0 |
| XENPO10288 | 6.44 | 114 | -8 | 122 | 6 | -8 | 17 | 0 |

Figure 90 (cont.)

| ID | | | | | | | | |
|---|---|---|---|---|---|---|---|---|
| XENP010289 | 6.20 | 110 | -12 | 122 | 6 | -12 | 16 | 0 |
| XENP010290 | 6.31 | 110 | -12 | 120 | 4 | -10 | 15 | 0 |
| XENP010324 | 5.92 | 106 | -16 | 124 | 8 | -18 | 19 | 3 |
| XENP010325 | 5.83 | 104 | -18 | 124 | 8 | -20 | 19 | 4 |
| XENP010326 | 5.75 | 104 | -16 | 126 | 10 | -22 | 19 | 5 |
| XENP010327 | 5.68 | 104 | -18 | 128 | 12 | -24 | 19 | 6 |
| XENP010425 | 7.30 | 120 | -2 | 120 | 4 | 0 | 16 | 0 |
| XENP010426 | 6.20 | 110 | -12 | 122 | 6 | -12 | 9 | 0 |
| XENP010427 | 6.27 | 110 | -12 | 120 | 4 | -10 | 18 | 0 |
| XENP010428 | 7.67 | 122 | 0 | 120 | 4 | 2 | 9 | 0 |
| XENP010466 | 6.20 | 110 | -12 | 122 | 6 | -12 | 18 | 0 |
| XENP010467 | 6.20 | 110 | -12 | 122 | 6 | -12 | 19 | 0 |
| XENP010468 | 6.20 | 110 | -12 | 122 | 6 | -12 | 17 | 0 |
| XENP010469 | 6.31 | 110 | -12 | 120 | 4 | -10 | 16 | 0 |
| XENP010470 | 6.27 | 110 | -12 | 120 | 4 | -10 | 26 | 0 |
| XENP010471 | 6.27 | 110 | -12 | 120 | 4 | -10 | 27 | 0 |
| XENP010472 | 6.20 | 110 | -12 | 122 | 6 | -12 | 10 | 0 |
| XENP010473 | 6.27 | 110 | -12 | 120 | 4 | -10 | 19 | 0 |
| XENP010474 | 7.30 | 120 | -2 | 120 | 4 | 0 | 17 | 0 |
| XENP010475 | 7.67 | 122 | 0 | 120 | 20 | 2 | 10 | 0 |
| XENP010476 | 5.31 | 100 | -22 | 136 | 18 | -36 | 8 | 4 |
| XENP010477 | 5.36 | 100 | -22 | 134 | 18 | -34 | 18 | 4 |
| XENP010478 | 6.27 | 110 | -12 | 120 | 4 | -10 | 23 | 0 |
| XENP010511 | 5.92 | 106 | -16 | 124 | 8 | -18 | 17 | 3 |
| XENP010512 | 5.83 | 104 | -18 | 124 | 8 | -20 | 17 | 4 |
| XENP010513 | 5.75 | 104 | -18 | 126 | 10 | -22 | 17 | 5 |
| XENP010517 | 5.92 | 106 | -16 | 124 | 8 | -18 | 18 | 3 |
| XENP010518 | 5.83 | 104 | -18 | 124 | 8 | -20 | 18 | 4 |
| XENP010519 | 5.75 | 104 | -18 | 126 | 10 | -22 | 19 | 5 |
| XENP010520 | 5.92 | 106 | -16 | 124 | 8 | -18 | 19 | 3 |
| XENP010521 | 5.83 | 104 | -18 | 124 | 8 | -20 | 19 | 4 |
| XENP010522 | 5.75 | 104 | -18 | 126 | 10 | -22 | 18 | 5 |
| XENP010525 | 5.54 | 102 | -20 | 130 | 14 | -28 | 18 | 4 |
| XENP010526 | 5.75 | 104 | -18 | 126 | 10 | -22 | 20 | 5 |

Figure 90 (cont.)

| ID | | | | | | | |
|---|---|---|---|---|---|---|---|
| XENPO10527 | 5.78 | 104 | -18 | 124 | 8 | -20 | 5 |
| XENPO10589 | 5.69 | 112 | -10 | 136 | 20 | -30 | 27 |
| XENPO10590 | 5.85 | 114 | -8 | 134 | 18 | -26 | 5 |
| XENPO10591 | 6.01 | 114 | -8 | 130 | 14 | -22 | 4 |
| XENPO10592 | 6.44 | 116 | -6 | 124 | 8 | -14 | 3 |
| XENPO10593 | 5.37 | 104 | -18 | 138 | 22 | -40 | 2 |
| XENPO10594 | 5.49 | 106 | -16 | 136 | 20 | -36 | 17 |
| XENPO10595 | 5.61 | 106 | -16 | 132 | 16 | -32 | 16 |
| XENPO10596 | 5.92 | 108 | -14 | 126 | 10 | -24 | 15 |
| XENPO10601 | 5.37 | 104 | -18 | 138 | 22 | -40 | 14 |
| XENPO10602 | 5.49 | 106 | -16 | 136 | 20 | -36 | 14 |
| XENPO10603 | 5.61 | 106 | -16 | 132 | 16 | -32 | 13 |
| XENPO10604 | 5.92 | 108 | -14 | 126 | 10 | -24 | 12 |
| XENPO10621 | 5.61 | 106 | -16 | 132 | 16 | -32 | 11 |
| XENPO10622 | 5.92 | 108 | -14 | 126 | 10 | -24 | 10 |
| XENPO10623 | 5.71 | 106 | -16 | 128 | 12 | -28 | 9 |
| XENPO10624 | 5.43 | 104 | -18 | 134 | 18 | -36 | 35 |
| XENPO10625 | 5.61 | 106 | -16 | 132 | 16 | -32 | 36 |
| XENPO10626 | 5.92 | 108 | -14 | 126 | 10 | -24 | 15 |
| XENPO10628 | 5.31 | 102 | -20 | 138 | 22 | -42 | 14 |
| XENPO10629 | 5.54 | 104 | -18 | 132 | 16 | -34 | 24 |
| XENPO10648 | 5.93 | 112 | -10 | 130 | 14 | -24 | 23 |
| XENPO10649 | 5.38 | 108 | -14 | 142 | 26 | -40 | 6 |
| XENPO10650 | 5.76 | 108 | -14 | 130 | 14 | -28 | 10 |
| XENPO10651 | 5.28 | 106 | -16 | 144 | 28 | -44 | 10 |
| XENPO10780 | 6.58 | 114 | -8 | 120 | 4 | -12 | 14 |
| XENPO10781 | 8.52 | 130 | 8 | 116 | 0 | 8 | 9 |
| XENPO10782 | 8.35 | 126 | 4 | 116 | 0 | 4 | 5 |

Figure 91

| XenP# | Protein_Name | Patent name (HC) | Patent name (LC) |
|---|---|---|---|
| XENP004547 | Bevacizumab - Avastin - IgG1 WT | IgG1-WT | Ck-WT |
| XENP006384 | Bevacizumab_Avastin_IgG2_WT | IgG2-WT | Ck-WT |
| NA | IgG3 example | IgG3-WT | Ck-WT |
| NA | IgG4 example | IgG4-WT | Ck-WT |
| XENP007349 | Bevacizumab Avastin IgG1/2 WT | IgG1/2-HC | Ck-WT |
| XENP005653 | Bevacizumab_Avastin_IgG1_N434S | IgG1-434S | Ck-WT |
| XENP006389 | Bevacizumab_Avastin_IgG2_N434S | IgG2-434S | Ck-WT |
| XENP009491 | Bevacizumab_IgG1_S119E/K133E/T164E/K205E/N209D/K210E | IgG1-CH1-pI(6) | Ck-WT |
| XENP009492 | Bevacizumab_IgG1_CL_mutations_K126E/K145E/N152D/S156E/K169E/S202E | IgG1-WT | Ck-pI(6) |
| XENP009493 | Bevacizumab_IgG1_CH-CL_pI_engineered_combo1 | IgG1-CH1-pI(6) | Ck-pI(6) |
| XENP009992 | Bevacizumab_Avastin_N434S_IgG1_CH1_pI(6)_CK_pI(6) | IgG1-CH1-pI(6)-434S | Ck-pI(6) |
| XENP009993 | Bevacizumab_Avastin_N434S/M428L_IgG1_CH1_pI(6)_CK_pI(6) | IgG1-CH1-pI(6)-428L/434S | Ck-pI(6) |
| XENP010088 | Bevacizumab_Avastin_IgG3_CK_pI(3) | IgG1-WT | Ck-pI(3) |
| XENP010089 | Bevacizumab_Avastin_IgG1_CK_pI(6-DEDE) | IgG1-WT | Ck-pI(6-DEDE) |
| XENP010090 | Bevacizumab_Avastin_IgG1_CK_pI(3) | IgG2-WT | Ck-pI(3) |
| XENP010091 | Bevacizumab_Avastin_IgG2_CK_pI(6) | IgG2-WT | Ck-pI(6) |
| XENP010092 | Bevacizumab_Avastin_IgG2_CK_pI(6-DEDE) | IgG2-WT | Ck-pI(6-DEDE) |
| XENP010093 | Bevacizumab_Avastin_pI-iso1_CK_WT | pI-iso1 | Ck-WT |
| XENP010094 | Bevacizumab_Avastin_pI-iso1(NF)_CK_WT | pI-iso1(NF) | Ck-WT |
| XENP010095 | Bevacizumab_Avastin_pI-iso1(NF-VE)_CK_WT | pI-iso1(NF-VE) | Ck-WT |
| XENP010096 | Bevacizumab_Avastin_pI-iso1(NF-VE)_CK_pI(3) | pI-iso1(NF-VE) | Ck-pI(3) |
| XENP010101 | Bevacizumab_Avastin_pI-iso1(NF-VE)_CK_pI(6) | pI-iso1(NF-VE) | Ck-pI(6) |
| XENP010102 | Bevacizumab_Avastin_pI-iso1(NF-VE)_CK_pI(6-DEDE) | pI-iso1(NF-VE) | Ck-pI(6-DEDE) |
| XENP010103 | Bevacizumab_Avastin_pI-iso1(NF-VE-DEDE)_CK_WT | pI-iso1(NF-VE-DEDE) | Ck-WT |
| XENP010104 | Bevacizumab_Avastin_pI-iso1(NF-VE-DEDE)_CK_pI(3) | pI-iso1(NF-VE-DEDE) | Ck-pI(3) |
| XENP010105 | Bevacizumab_Avastin_pI-iso1(NF-VE-DEDE)_CK_pI(6) | pI-iso1(NF-VE-DEDE) | Ck-pI(6) |
| XENP010106 | Bevacizumab_Avastin_pI-iso1(NF-VE-DEDE)_CK_pI(6-DEDE) | pI-iso1(NF-VE-DEDE) | Ck-pI(6-DEDE) |
| XENP010107 | Bevacizumab_Avastin_IgG1_pI(7)_CK_pI(4) | IgG1-pI(7) | Ck-pI(4) |
| XENP010108 | Bevacizumab_Avastin_IgG1_pI(11)_CK_pI(4) | IgG1-pI(11) | Ck-pI(4) |
| XENP010109 | Bevacizumab_Avastin_IgG1/2_pI(7)_CK_pI(4) | IgG1/2-pI(7) | Ck-pI(4) |

Figure 91 (cont.)

| ID | Description | | |
|---|---|---|---|
| | | igG1/2-pI(11) | Ck-pI(4) |
| XENP010110 | Bevacizumab_Avastin_IgG1/2_pI(11)_CK_pI(4) | | |
| XENP010017 | Bevacizumab_Avastin_IgG1_CH/CL_charge_neutral_to_negative | igG1-pI(6)-Neutral-to-DE | CK-N152D S15 |
| XENP010018 | Bevacizumab_Avastin_IgG1_CH/CL_charge_positive_to_neutral | igG1-pI(6)-KR-to-Neutral | CK-K126Q K14 |
| XENP010019 | Bevacizumab_Avastin_IgG1_pI(3)_CH/CL_charge_positive_to_negative | igG1-pI(6)-KR-to-DE | CK-K126E K14 |
| XENP010178 | Bevacizumab_Avastin_pI_iso2_CK_WT | igG-pI-iso2 | Ck-WT |
| XENP010179 | Bevacizumab_Avastin_pI_iso3_CK_WT | igG-pI-iso3 | Ck-WT |
| XENP010180 | Bevacizumab_Avastin_pI_iso2_N434S_CK_WT | igG-pI-iso2-434S | Ck-WT |
| XENP010181 | Bevacizumab_Avastin_pI_iso3_N434S_CK_WT | igG-pI-iso3-434S | Ck-WT |
| XENP010182 | Bevacizumab_Avastin_pI_iso2_CK_pI(4) | igG-pI-iso2 | Ck-pI(4) |
| XENP010183 | Bevacizumab_Avastin_pI_iso3_CK_pI(4) | igG-pI-iso3 | Ck-pI(4) |
| XENP010184 | Bevacizumab_Avastin_pI_iso2_N434S_CK_pI(4) | igG-pI-iso2-434S | Ck-pI(4) |
| XENP010185 | Bevacizumab_Avastin_pI_iso3_N434S_CK_pI(4) | igG-pI-iso3-434S | Ck-pI(4) |
| XENP010265 | Bevacizumab_Avastin_pI_iso3_T222K | | |
| XENP010266 | Bevacizumab_Avastin_pI_iso3_Q274K | | |
| XENP010267 | Bevacizumab_Avastin_pI_iso3_F296Y | | |
| XENP010268 | Bevacizumab_Avastin_pI_iso3_F300Y | | |
| XENP010269 | Bevacizumab_Avastin_pI_iso3_V309L | | |
| XENP010270 | Bevacizumab_Avastin_pI_iso3_T339A | | |
| XENP010271 | Bevacizumab_Avastin_pI_iso3_Q355R | | |
| XENP010272 | Bevacizumab_Avastin_pI_iso3_S384N | | |
| XENP010273 | Bevacizumab_Avastin_pI_iso3_N392K | | |
| XENP010274 | Bevacizumab_Avastin_pI_iso3_M397V | | |
| XENP010275 | Bevacizumab_Avastin_pI_iso3_E419Q | | |
| XENP010276 | Bevacizumab_Avastin_pI_iso3_F296Y/F300Y | | |
| XENP010277 | Bevacizumab_Avastin_pI_iso3_S384N/N392K/M397V | | |
| XENP010278 | Bevacizumab_Avastin_pI_iso3_E137G | | |
| XENP010279 | Bevacizumab_Avastin_pI_iso3_S138G | | |
| XENP010280 | Bevacizumab_Avastin_pI_iso3_N192S | | |
| XENP010281 | Bevacizumab_Avastin_pI_iso3_F193L | | |
| XENP010282 | Bevacizumab_Avastin_pI_iso3_T199I | | |
| XENP010283 | Bevacizumab_Avastin_pI_iso3_D203N | | |
| XENP010284 | Bevacizumab_Avastin_pI_iso3_T214K | | |
| XENP010285 | Bevacizumab_Avastin_pI_iso3_E137G/S138G | | |

Figure 91 (cont.)

| | | | |
|---|---|---|---|
| XENP010286 | Bevacizumab_Avastin_pI_iso3_N192S/F193L | IgG-pI-Iso3-SL | Ck-WT |
| XENP010287 | Bevacizumab_Avastin_pI_iso3_T199I/D203N | | |
| XENP010288 | Bevacizumab_Avastin_pI_iso3_T214K/T222K | | |
| XENP010289 | Bevacizumab_Avastin_pI_iso3_S138G/N192S/F193L | | |
| XENP010290 | Bevacizumab_Avastin_pI_iso3_E137G/S138G/N192S/F193L | | |
| XENP010324 | Bevacizumab_Avastin_H0_pI_iso3_L0_Ckappa_iso(3) | IgG-pI-iso3 | Ck-Iso(3) |
| XENP010325 | Bevacizumab_Avastin_H0_pI_iso3_L0_Ckappa_iso(4) | IgG-pI-iso3 | Ck-Iso(4) |
| XENP010326 | Bevacizumab_Avastin_H0_pI_iso3_L0_Ckappa_iso(5) | IgG-pI-iso3 | Ck-Iso(5) |
| XENP010327 | Bevacizumab_Avastin_H0_pI_iso3_L0_Ckappa_iso(6) | IgG-pI-iso3 | Ck-Iso(6) |
| XENP010425 | Bevacizumab_Avastin_H0L0_IgG2_CH1_IgG1_CH2_CH3 | | |
| XENP010426 | Bevacizumab_Avastin_H0L0_pI_iso3_charges_only | IgG-pI-iso3-charges-only | Ck-WT |
| XENP010427 | Bevacizumab_Avastin_H0L0_pI_iso2_charges_only | IgG-pI-iso2-charges-only | Ck-WT |
| XENP010428 | Bevacizumab_Avastin_H0L0_IgG2_CH1_IgG1_Hinge_CH2_CH3 | | |
| XENP010466 | Bevacizumab_Avastin_H0L0_pI_iso3_N192S/F193L_N434S | IgG-pI-iso3-SL-434S | Ck-WT |
| XENP010467 | Bevacizumab_Avastin_H0L0_pI_iso3_N192S/F193L_M428L/N434S | IgG-pI-iso3-SL-428L/434S | Ck-WT |
| XENP010468 | Bevacizumab_Avastin_H0L0_pI_iso3_S138G/N192S/F193L_N434S | | |
| XENP010469 | Bevacizumab_Avastin_H0L0_pI_iso3_E137G/S138G/N192S/F193L_N434S | | |
| XENP010470 | Bevacizumab_Avastin_H0L0_pI_iso2_N192S/F193L | IgG-pI-iso2-SL | Ck-WT |
| XENP010471 | Bevacizumab_Avastin_H0L0_pI_iso2_N192S/F193L_N434S | IgG-pI-iso2-SL-434S | Ck-WT |
| XENP010472 | Bevacizumab_Avastin_H0L0_pI_iso3_charges_only_N434S | IgG-pI-iso3-charges-only-434S | Ck-WT |
| XENP010473 | Bevacizumab_Avastin_H0L0_pI_iso2_charges_only_N434S | IgG-pI-iso2-charges-only-434S | Ck-WT |
| XENP010474 | Bevacizumab_Avastin_H0L0_IgG2_CH1_IgG1_CH2_CH3_N434S | | |
| XENP010475 | Bevacizumab_Avastin_H0L0_IgG2_CH1_IgG1_Hinge_CH2_CH3_N434S | | |
| XENP010476 | Bevacizumab_Avastin_H0L0_IgG1_pI(7)_N434S_CK_pI(4) | IgG1_pI(7)-434S | Ck-pI(4) |
| XENP010477 | Bevacizumab_Avastin_H0L0_IgG1/2_pI(7)_N434S_CK_pI(4) | IgG1/2_pI(7)-434S | Ck-pI(4) |
| XENP010478 | Bevacizumab_Avastin_H0L0_pI_iso1/2_charges_only | | |
| XENP010511 | Bevacizumab_Avastin_H0_pI_iso3_N192S/F193L_L0_Ckappa_iso(3) | IgG-pI-iso3-SL | Ck-Iso(3) |
| XENP010512 | Bevacizumab_Avastin_H0_pI_iso3_N192S/F193L_L0_Ckappa_iso(4) | IgG-pI-iso3-SL | Ck-Iso(4) |
| XENP010513 | Bevacizumab_Avastin_H0_pI_iso3_N192S/F193L_L0_Ckappa_iso(5) | IgG-pI-iso3-SL | Ck-Iso(5) |
| XENP010517 | Bevacizumab_Avastin_H0_pI_iso3_N192S/F193L_N434S_L0_Ckappa_iso(3) | IgG-pI-iso3-SL-434S | Ck-Iso(3) |
| XENP010518 | Bevacizumab_Avastin_H0_pI_iso3_N192S/F193L_N434S_L0_Ckappa_iso(4) | IgG-pI-iso3-SL-434S | Ck-Iso(4) |
| XENP010519 | Bevacizumab_Avastin_H0_pI_iso3_N192S/F193L_N434S_L0_Ckappa_iso(5) | IgG-pI-iso3-SL-434S | Ck-Iso(5) |
| XENP010520 | Bevacizumab_Avastin_H0_pI_iso3_N192S/F193L_M428L/N434S_L0_Ckappa_iso(3) | IgG-pI-iso3-SL-428L/434S | Ck-Iso(3) |

Figure 91 (cont.)

| ID | Name | Construct | Variant |
|---|---|---|---|
| XENP010521 | Bevacizumab_Avastin_H0_pI_iso3_N192S/F193L_M428L/N434S_LO_Ckappa_iso(4) | IgG-pI-iso3-SL-428L/434S | Ck-iso(4) |
| XENP010522 | Bevacizumab_Avastin_H0_pI_iso3_N192S/F193L_M428L/N434S_LO_Ckappa_iso(5) | IgG-pI-iso3-SL-428L/434S | Ck-iso(5) |
| XENP010525 | Bevacizumab_Avastin_HFL0_pI_iso3_N192S/F193L_N434S_CK_pI(4) | IgG-pI-iso3-SL-434S | Ck-pI(4) |
| XENP010526 | Bevacizumab_Avastin_H0_pI_iso3_N434S_LO_Ckappa_iso(5) | IgG-pI-iso3-434S | Ck-iso(5) |
| XENP010527 | Bevacizumab_Avastin_H0_pI_iso2_N192S/F193L_N434S_LO_Ckappa_iso(5) | IgG-pI-iso2-SL-434S | Ck-iso(5) |
| XENP010589 | Bevacizumab_Avastin_IgG1_pI_variant_CH4CK8 | IgG-pI-CH1-v4 | Ck-v8 |
| XENP010590 | Bevacizumab_Avastin_IgG1_pI_variant_CH25CK28 | IgG-pI-CH1-v25 | Ck-v28 |
| XENP010591 | Bevacizumab_Avastin_IgG1_pI_variant_CH42CK23 | IgG-pI-CH1-v42 | Ck-v23 |
| XENP010592 | Bevacizumab_Avastin_IgG1_pI_variant_CH16CK12 | IgG-pI-CH1-v16 | Ck-v12 |
| XENP010593 | Bevacizumab_Avastin_pI_variant_CH4_SLFFV_9merISO_N434S_CK8 | IgG-pI-CH1-v4-SLFFV-Iso-434S | Ck-v8 |
| XENP010594 | Bevacizumab_Avastin_pI_variant_CH25_SLFFV_9merISO_N434S_CK28 | IgG-pI-CH1-v25-SLFFV-Iso-434S | Ck-v28 |
| XENP010595 | Bevacizumab_Avastin_pI_variant_CH42_SLFFV_9merISO_N434S_CK23 | IgG-pI-CH1-v42-SLFFV-Iso-434S | Ck-v23 |
| XENP010596 | Bevacizumab_Avastin_pI_variant_CH16_SLFFV_9merISO_N434S_CK12 | IgG-pI-CH1-v16-SLFFV-Iso-434S | Ck-v12 |
| XENP010601 | Bevacizumab_Avastin_pI_variant_CH4_SL_9merISO_N434S_CK8 | IgG-pI-CH1-v4-SL-Iso-434S | Ck-v8 |
| XENP010602 | Bevacizumab_Avastin_pI_variant_CH25_SL_9merISO_N434S_CK28 | IgG-pI-CH1-v25-SL-Iso-434S | Ck-v28 |
| XENP010603 | Bevacizumab_Avastin_pI_variant_CH42_SL_9merISO_N434S_CK23 | IgG-pI-CH1-v42-SL-Iso-434S | Ck-v23 |
| XENP010604 | Bevacizumab_Avastin_pI_variant_CH16_SL_9merISO_N434S_CK12 | IgG-pI-CH1-v16-SL-Iso-434S | Ck-v12 |
| XENP010621 | Bevacizumab_Avastin_pI_IgG1_IF16_ISO_CK23 | IgG1-pI-IF16-ISO | Ck-v23 |
| XENP010622 | Bevacizumab_Avastin_pI_IgG1_IF10_ISO_CK12 | IgG1-pI-IF10-ISO | Ck-v12 |
| XENP010623 | Bevacizumab_Avastin_pI_IgG2_IF10_ISO_N434S_CK12 | IgG2-pI-IF10-ISO-N434S | Ck-v12 |
| XENP010624 | Bevacizumab_Avastin_pI_IgG2_IF16_ISO_N434S_CK23 | IgG2-pI-IF16-ISO-N434S | Ck-v23 |
| XENP010625 | Bevacizumab_Avastin_pI_Hybrid_IF16_ISO_N434S_CK23 | Hybrid-pI-IF16-ISO-N434S | Ck-v23 |
| XENP010626 | Bevacizumab_Avastin_pI_Hybrid_IF10_ISO_N434S_CK12 | Hybrid-pI-IF10-ISO-N434S | Ck-v12 |
| XENP010628 | Bevacizumab_Avastin_pI_Hybrid_2-1-2-pI_IF16_ISO_N434S_CK23 | Hybrid-2-1-2-pI-IF16-ISO-N434S | Ck-v23 |
| XENP010629 | Bevacizumab_Avastin_pI_Hybrid_2-1-2-pI_IF10_ISO_N434S_CK12 | Hybrid-2-1-2-pI-IF10-ISO-N434S | Ck-v12 |
| XENP010648 | Bevacizumab_Avastin_pI_IgG1_IF10_CH1-Fc_charges_CK12 | IgG1-IF10-CH1-Fc-charges | Ck-v12 |
| XENP010649 | Bevacizumab_Avastin_pI_IgG1_IF16_CH1-Fc_charges_CK23 | IgG1-IF16-CH1-Fc-charges | Ck-v23 |
| XENP010650 | Bevacizumab_Avastin_pI_IgG1_IF10_ISO_CH1-Fc_charges_CK12 | IgG1-IF10-ISO-CH1-Fc-charges | Ck-v12 |
| XENP010651 | Bevacizumab_Avastin_pI_IgG1_IF16_ISO_CH1-Fc_charges_CK23 | IgG1-IF16-ISO-CH1-Fc-charges | Ck-v23 |
| XENP010780 | Bevacizumab_IgG1_pI_ISO(-)/pI_ISO(-) | IgG1-pI-ISO(-) | Ck-WT |
| XENP010781 | Bevacizumab_IgG1_pI_ISO(+RR)/pI_ISO(+RR) | IgG1-pI-ISO(+RR) | Ck-WT |
| XENP010782 | Bevacizumab_IgG1_pI_ISO(+)/pI_ISO(+) | IgG1-pI-ISO(+) | Ck-WT |

Figure 92

| SEQ ID NO | XenP | Patent name (HC) | Sequence |
|---|---|---|---|
| SEQ ID NO: 149 | XENP004547 | IgG1-WT | ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK |
| SEQ ID NO: 150 | XENP006384 | IgG2-WT | ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKSRWQQGNVFSCSVMHEALHNHYTQKSLSLSPGK |
| SEQ ID NO: 151 | NA | IgG3-WT | ASTKGPSVFPLAPCSRSTSGGTAALGCLVKDYFPEPVTVSWNSGALTSGVHTFPAVLQSSGLYSLSSVVTVPSSSLGTQTYTCNVNHKPSNTKVDKRVELKTPLGDTTHTCPRCPAPELLGGPSVFLFPPKPKDTLMISRTPEVTCVVVDVSHEDPEVQFKWYVDGVEVHNAKTKPREEQYNSTFRVVSVLTVLHQDWLNGKEYKCKVSNKALPAPIEKTISKTKGQPREPQVYTLPPSREEMTKNQVSLTCLVKGFYPSDIAVEWESSGQPENNYNTTPPMLDSDGSFFLYSKLTVDKSRWQQGNIFSCSVMHEALHNRFTQKSLSLSPGK |
| SEQ ID NO: 152 | NA | IgG4-WT | ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK |
| SEQ ID NO: 153 | XENP007349 | IgG1/2-HC | ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK |
| SEQ ID NO: 154 | XENP005653 | IgG1-434S | ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHSHYTQKSLSLSPGK |

Figure 92 (cont.)

| | XenP | Patent name (HC) | Sequence |
|---|---|---|---|
| SEQ ID NO: 155 | XENP006389 | IgG2-434S | ASTKGPSVFPLAPCSRSTSESTAALGCLVKDYFPEPVTVSWNSGALTSGVHTFPAVLQS SGLYSLSSVVTVPSSNFGTQTYTCNVDHKPSNTKVDKTVERKCCVECPPCPAPPVAGP SVFLFPPKPKDTLMISRTPEVTCVVVDVSHEDPEVQFNWYVDGVEVHNAKTKPREEQF NSTFRVVSVLTVVHQDWLNGKEYKCKVSNKGLPAPIEKTISKTKGQPREPQVYTLPPSR EEMTKNQVSLTCLVKGFYPSDIAVEWESNGQPENNYKTTPPMLDSDGSFFLYSKLTVD KSRWQQGNVFSCSVMHEALHSHYTQKSLSLSPGK |
| SEQ ID NO: 156 | XENP009491 | IgG1-CH1-pI(6) | AETKGPSVFPLAPSSESTSGGTAALGCLVKDYFPEPVTVSWNSGALTSGVHTFPAVLQ SSGLYSLSSVVTVPSSSLGTQTYICNVNHEPSDTEVDKKVEPKSCDKTHTCPPCPAPEL LGGPSVFLFPPKPKDTLMISRTPEVTCVVVDVSHEDPEVKFNWYVDGVEVHNAKTKPR EEQYNSTYRVVSVLTVLHQDWLNGKEYKCKVSNKALPAPIEKTISKAKGQPREPQVYTL PPSREEMTKNQVSLTCLVKGFYPSDIAVEWESNGQPENNYKTTPPVLDSDGSFFLYSKL TVDKSRWQQGNVFSCSVMHEALHNHYTQKSLSLSPGK |
| SEQ ID NO: 157 | XENP009492 | IgG1-WT | ASTKGPSVFPLAPSSKSTSGGTAALGCLVKDYFPEPVTVSWNSGALTSGVHTFPAVLQ SSGLYSLSSVVTVPSSSLGTQTYICNVNHKPSNTKVDKKVEPKSCDKTHTCPPCPAPEL LGGPSVFLFPPKPKDTLMISRTPEVTCVVVDVSHEDPEVKFNWYVDGVEVHNAKTKPR EEQYNSTYRVVSVLTVLHQDWLNGKEYKCKVSNKALPAPIEKTISKAKGQPREPQVYTL PPSREEMTKNQVSLTCLVKGFYPSDIAVEWESNGQPENNYKTTPPVLDSDGSFFLYSKL TVDKSRWQQGNVFSCSVMHEALHNHYTQKSLSLSPGK |
| SEQ ID NO: 158 | XENP009493 | IgG1-CH1-pI(6) | AETKGPSVFPLAPSSESTSGGTAALGCLVKDYFPEPVTVSWNSGALESGVHTFPAVLQ SSGLYSLSSVVTVPSSSLGTQTYICNVNHEPSDTEVDKKVEPKSCDKTHTCPPCPAPEL LGGPSVFLFPPKPKDTLMISRTPEVTCVVVDVSHEDPEVKFNWYVDGVEVHNAKTKPR EEQYNSTYRVVSVLTVLHQDWLNGKEYKCKVSNKALPAPIEKTISKAKGQPREPQVYTL PPSREEMTKNQVSLTCLVKGFYPSDIAVEWESNGQPENNYKTTPPVLDSDGSFFLYSKL TVDKSRWQQGNVFSCSVMHEALHNHYTQKSLSLSPGK |
| SEQ ID NO: 159 | XENP009992 | IgG1-CH1-pI(6)-434S | AETKGPSVFPLAPSSESTSGGTAALGCLVKDYFPEPVTVSWNSGALESGVHTFPAVLQ SSGLYSLSSVVTVPSSSLGTQTYICNVNHEPSDTEVDKKVEPKSCDKTHTCPPCPAPEL LGGPSVFLFPPKPKDTLMISRTPEVTCVVVDVSHEDPEVKFNWYVDGVEVHNAKTKPR EEQYNSTYRVVSVLTVLHQDWLNGKEYKCKVSNKALPAPIEKTISKAKGQPREPQVYTL PPSREEMTKNQVSLTCLVKGFYPSDIAVEWESNGQPENNYKTTPPVLDSDGSFFLYSKL TVDKSRWQQGNVFSCSVMHEALHSHYTQKSLSLSPGK |
| SEQ ID NO: 160 | XENP009993 | IgG1-CH1-pI(6)-428L/434S | AETKGPSVFPLAPSSESTSGGTAALGCLVKDYFPEPVTVSWNSGALESGVHTFPAVLQ SSGLYSLSSVVTVPSSSLGTQTYICNVNHEPSDTEVDKKVEPKSCDKTHTCPPCPAPEL LGGPSVFLFPPKPKDTLMISRTPEVTCVVVDVSHEDPEVKFNWYVDGVEVHNAKTKPR EEQYNSTYRVVSVLTVLHQDWLNGKEYKCKVSNKALPAPIEKTISKAKGQPREPQVYTL PPSREEMTKNQVSLTCLVKGFYPSDIAVEWESNGQPENNYKTTPPVLDSDGSFFLYSKL TVDKSRWQQGNVFSCSVLHEALHSHYTQKSLSLSPGK |

Figure 92 (cont.)

| | XenP | Patent name (HC) | Sequence |
|---|---|---|---|
| SEQ ID NO: 161 | XENP010088 | IgG1-WT | ASTKGPSVFPLAPSSKSTSGGTAALGCLVKDYFPEPVTVSWNSGALTSGVHTFPAVLQ SSGLYSLSSVVTVPSSSLGTQTYICNVNHKPSNTKVDKKVEPKSCDKTHTCPPCPAPEL LGGPSVFLFPPKPKDTLMISRTPEVTCVVVDVSHEDPEVKFNWYVDGVEVHNAKTKPR EEQYNSTYRVVSVLTVLHQDWLNGKEYKCKVSNKALPAPIEKTISKAKGQPREPQVYTL PPSREEMTKNQVSLTCLVKGFYPSDIAVEWESNGQPENNYKTTPPVLDSDGSFFLYSKL TVDKSRWQQGNVFSCSVMHEALHNHYTQKSLSLSPGK |
| SEQ ID NO: 162 | XENP010089 | IgG1-WT | ASTKGPSVFPLAPSSKSTSGGTAALGCLVKDYFPEPVTVSWNSGALTSGVHTFPAVLQ SSGLYSLSSVVTVPSSSLGTQTYICNVNHKPSNTKVDKKVEPKSCDKTHTCPPCPAPEL LGGPSVFLFPPKPKDTLMISRTPEVTCVVVDVSHEDPEVKFNWYVDGVEVHNAKTKPR EEQYNSTYRVVSVLTVLHQDWLNGKEYKCKVSNKALPAPIEKTISKAKGQPREPQVYTL PPSREEMTKNQVSLTCLVKGFYPSDIAVEWESNGQPENNYKTTPPVLDSDGSFFLYSKL TVDKSRWQQGNVFSCSVMHEALHNHYTQKSLSLSPGK |
| SEQ ID NO: 163 | XENP010090 | IgG2-WT | ASTKGPSVFPLAPCSRSTSESTAALGCLVKDYFPEPVTVSWNSGALTSGVHTFPAVLQS SGLYSLSSVVTVPSSNFGTQTYTCNVDHKPSNTKVDKTVERKCCVECPPCPAPPVAGP SVFLFPPKPKDTLMISRTPEVTCVVVDVSHEDPEVQFNWYVDGVEVHNAKTKPREEQF NSTFRVVSVLTVVHQDWLNGKEYKCKVSNKGLPAPIEKTISKTKGQPREPQVYTLPPSR EEMTKNQVSLTCLVKGFYPSDIAVEWESNGQPENNYKTTPPMLDSDGSFFLYSKLTVD KSRWQQGNVFSCSVMHEALHNHYTQKSLSLSPGK |
| SEQ ID NO: 164 | XENP010091 | IgG2-WT | ASTKGPSVFPLAPCSRSTSESTAALGCLVKDYFPEPVTVSWNSGALTSGVHTFPAVLQS SGLYSLSSVVTVPSSNFGTQTYTCNVDHKPSNTKVDKTVERKCCVECPPCPAPPVAGP SVFLFPPKPKDTLMISRTPEVTCVVVDVSHEDPEVQFNWYVDGVEVHNAKTKPREEQF NSTFRVVSVLTVVHQDWLNGKEYKCKVSNKGLPAPIEKTISKTKGQPREPQVYTLPPSR EEMTKNQVSLTCLVKGFYPSDIAVEWESNGQPENNYKTTPPMLDSDGSFFLYSKLTVD KSRWQQGNVFSCSVMHEALHNHYTQKSLSLSPGK |
| SEQ ID NO: 165 | XENP010092 | IgG2-WT | ASTKGPSVFPLAPCSRSTSESTAALGCLVKDYFPEPVTVSWNSGALTSGVHTFPAVLQS SGLYSLSSVVTVPSSNFGTQTYTCNVDHKPSNTKVDKTVERKCCVECPPCPAPPVAGP SVFLFPPKPKDTLMISRTPEVTCVVVDVSHEDPEVQFNWYVDGVEVHNAKTKPREEQF NSTFRVVSVLTVVHQDWLNGKEYKCKVSNKGLPAPIEKTISKTKGQPREPQVYTLPPSR EEMTKNQVSLTCLVKGFYPSDIAVEWESNGQPENNYKTTPPMLDSDGSFFLYSKLTVD KSRWQQGNVFSCSVMHEALHNHYTQKSLSLSPGK |
| SEQ ID NO: 166 | XENP010093 | pI-Iso1 | ASTKGPSVFPLAPSSKSTSESTAALGCLVKDYFPEPVTVSWNSGALTSGVHTFPAVLQS SGLYSLSSVVTVPSSSLGTQTYTCNVDHKPSNTKVDKTVEPKSCDTTHTCPPCPAPELL GGPSVFLFPPKPKDTLMISRTPEVTCVVVDVSHEDPEVQFNWYVDGVEVHNAKTKPRE EQYNSTYRVVSVLTVLHQDWLNGKEYKCKVSNKALPAPIEKTISKAKGQPREPQVYTLP PSQEEMTKNQVSLTCLVKGFYPSDIAVEWESSGQPENNYNTTPPMLDSDGSFFLYSKL TVDKSRWQEGNVFSCSVMHEALHNHYTQKSLSLSPG |

Figure 92 (cont.)

| SEQ ID NO: | XenP | Patent name (HC) | Sequence |
|---|---|---|---|
| SEQ ID NO: 167 | XENP010094 | pI-Iso1(NF) | ASTKGPSVFPLAPSSKSTSESTAALGCLVKDYFPEPVTVSWNSGALTSGVHTFPAVLQS SGLYSLSSVVTVPSSNFGTQTYTCNVDHKPSNTKVDKTVEPKSCDTTHTCPPCPAPELL GGPSVFLFPPKPKDTLMISRTPEVTCVVVDVSHEDPEVQFNWYVDGVEVHNAKTKPRE EQYNSTYRVVSVLTVLHQDWLNGKEYKCKVSNKALPAPIEKTISKAKGQPREPQVYTLP PSQEEMTKNQVSLTCLVKGFYPSDIAVEWESSGQPENNYNTTPPMLDSDGSFFLYSKL TVDKSRWQEGNVFSCSVMHEALHNHYTQKSLSLSPG |
| SEQ ID NO: 168 | XENP010095 | pI-Iso1(NF-VE) | ASTKGPSVFPLAPSSKSTSESTAALGCLVKDYFPEPVTVSWNSGALTSGVHTFPAVLQS SGLYSLSSVVTVPSSNFGTQTYTCNVDHKPSNTKVDKTVEPKSCVECPPCPAPELLGG PSVFLFPPKPKDTLMISRTPEVTCVVVDVSHEDPEVQFNWYVDGVEVHNAKTKPREEQ YNSTYRVVSVLTVLHQDWLNGKEYKCKVSNKALPAPIEKTISKAKGQPREPQVYTLPPS QEEMTKNQVSLTCLVKGFYPSDIAVEWESSGQPENNYNTTPPMLDSDGSFFLYSKLTV DKSRWQEGNVFSCSVMHEALHNHYTQKSLSLSPG |
| SEQ ID NO: 169 | XENP010096 | pI-Iso1(NF-VE) | ASTKGPSVFPLAPSSKSTSESTAALGCLVKDYFPEPVTVSWNSGALTSGVHTFPAVLQS SGLYSLSSVVTVPSSNFGTQTYTCNVDHKPSNTKVDKTVEPKSCVECPPCPAPELLGG PSVFLFPPKPKDTLMISRTPEVTCVVVDVSHEDPEVQFNWYVDGVEVHNAKTKPREEQ YNSTYRVVSVLTVLHQDWLNGKEYKCKVSNKALPAPIEKTISKAKGQPREPQVYTLPPS QEEMTKNQVSLTCLVKGFYPSDIAVEWESSGQPENNYNTTPPMLDSDGSFFLYSKLTV DKSRWQEGNVFSCSVMHEALHNHYTQKSLSLSPG |
| SEQ ID NO: 170 | XENP010101 | pI-Iso1(NF-VE) | ASTKGPSVFPLAPSSKSTSESTAALGCLVKDYFPEPVTVSWNSGALTSGVHTFPAVLQS SGLYSLSSVVTVPSSNFGTQTYTCNVDHKPSNTKVDKTVEPKSCVECPPCPAPELLGG PSVFLFPPKPKDTLMISRTPEVTCVVVDVSHEDPEVQFNWYVDGVEVHNAKTKPREEQ YNSTYRVVSVLTVLHQDWLNGKEYKCKVSNKALPAPIEKTISKAKGQPREPQVYTLPPS QEEMTKNQVSLTCLVKGFYPSDIAVEWESSGQPENNYNTTPPMLDSDGSFFLYSKLTV DKSRWQEGNVFSCSVMHEALHNHYTQKSLSLSPG |
| SEQ ID NO: 171 | XENP010102 | pI-Iso1(NF-VE) | ASTKGPSVFPLAPSSKSTSESTAALGCLVKDYFPEPVTVSWNSGALTSGVHTFPAVLQS SGLYSLSSVVTVPSSNFGTQTYTCNVDHKPSNTKVDKTVEPKSCVECPPCPAPELLGG PSVFLFPPKPKDTLMISRTPEVTCVVVDVSHEDPEVQFNWYVDGVEVHNAKTKPREEQ YNSTYRVVSVLTVLHQDWLNGKEYKCKVSNKALPAPIEKTISKAKGQPREPQVYTLPPS QEEMTKNQVSLTCLVKGFYPSDIAVEWESSGQPENNYNTTPPMLDSDGSFFLYSKLTV DKSRWQEGNVFSCSVMHEALHNHYTQKSLSLSPG |
| SEQ ID NO: 172 | XENP010103 | pI-Iso1(NF-VE-DEDE) | ASTKGPSVFPLAPSSKSTSESTAALGCLVKDYFPEPVTVSWNSGALTSGVHTFPAVLQS SGLYSLSSVVTVPSSNFGTQTYTCNVDHKPSNTKVDKTVEPKSCVECPPCPAPELLGG PSVFLFPPKPKDTLMISRTPEVTCVVVDVSHEDPEVQFNWYVDGVEVHNAKTKPREEQ YNSTYRVVSVLTVLHQDWLNGKEYKCKVSNKALPAPIEKTISKAKGQPREPQVYTLPPS QEEMTKNQVSLTCLVKGFYPSDIAVEWESSGQPENNYNTTPPMLDSDGSFFLYSKLTV DKSRWQEGNVFSCSVMHEALHNHYTQKSLSLSPGDEDE |

Figure 92 (cont.)

| | XenP | Patent name (HC) | Sequence |
|---|---|---|---|
| SEQ ID NO: 173 | XENP010104 | pI-Iso1(NF-VE-DEDE) | ASTKGPSVFPLAPSSKSTSESTAALGCLVKDYFPEPVTVSWNSGALTSGVHTFPAVLQS SGLYSLSSVVTVPSSNFGTQTYTCNVDHKPSNTKVDKTVEPKSCVECPPCPAPELLGG PSVFLFPPKPKDTLMISRTPEVTCVVVDVSHEDPEVQFNWYVDGVEVHNAKTKPREEQ YNSTYRVVSVLTVLHQDWLNGKEYKCKVSNKALPAPIEKTISKAKGQPREPQVYTLPPS QEEMTKNQVSLTCLVKGFYPSDIAVEWESSGQPENNYNTTPPMLDSDGSFFLYSKLTV DKSRWQEGNVFSCSVMHEALHNHYTQKSLSLSPGDEDE |
| SEQ ID NO: 174 | XENP010105 | pI-Iso1(NF-VE-DEDE) | ASTKGPSVFPLAPSSKSTSESTAALGCLVKDYFPEPVTVSWNSGALTSGVHTFPAVLQS SGLYSLSSVVTVPSSNFGTQTYTCNVDHKPSNTKVDKTVEPKSCVECPPCPAPELLGG PSVFLFPPKPKDTLMISRTPEVTCVVVDVSHEDPEVQFNWYVDGVEVHNAKTKPREEQ YNSTYRVVSVLTVLHQDWLNGKEYKCKVSNKALPAPIEKTISKAKGQPREPQVYTLPPS QEEMTKNQVSLTCLVKGFYPSDIAVEWESSGQPENNYNTTPPMLDSDGSFFLYSKLTV DKSRWQEGNVFSCSVMHEALHNHYTQKSLSLSPGDEDE |
| SEQ ID NO: 175 | XENP010106 | pI-Iso1(NF-VE-DEDE) | ASTKGPSVFPLAPSSKSTSESTAALGCLVKDYFPEPVTVSWNSGALTSGVHTFPAVLQS SGLYSLSSVVTVPSSNFGTQTYTCNVDHKPSNTKVDKTVEPKSCVECPPCPAPELLGG PSVFLFPPKPKDTLMISRTPEVTCVVVDVSHEDPEVQFNWYVDGVEVHNAKTKPREEQ YNSTYRVVSVLTVLHQDWLNGKEYKCKVSNKALPAPIEKTISKAKGQPREPQVYTLPPS QEEMTKNQVSLTCLVKGFYPSDIAVEWESSGQPENNYNTTPPMLDSDGSFFLYSKLTV DKSRWQEGNVFSCSVMHEALHNHYTQKSLSLSPGDEDE |
| SEQ ID NO: 176 | XENP010107 | IgG1-pI(7) | ASTKGPSVFPLAPSSESTSGGTAALGCLVKDYFPEPVTVSWNSGALTSGVHTFPAVLQ SSGLYSLSSVVTVPSSSLGTQTYICNVNHEPSNTEVDKKVEPKSCDKTHTCPPCPAPEL LGGPSVFLFPPKPKDTLMISRTPEVTCVVVDVSHEDPEVEFNWYVDGVEVHNAKTKPR EEQYNSTYRVVSVLTVLHQDWLNGKEYKCKVSNKALPAPIEKTISKAKGQPREPQVYTL PPSEEEMTKNQVSLTCLVKGFYPSDIAVEWESNGQPENNYETTPPVLDSDGSFFLYSKL TVDKSRWQQGNVFSCSVMHEALHNHYTQKSLSLSPG |
| SEQ ID NO: 177 | XENP010108 | IgG1-pI(11) | ASTKGPSVFPLAPSSESTSGGTAALGCLVKDYFPEPVTVSWNSGALTSGVHTFPAVLQ SSGLYSLSSVVTVPSSSLGTQTYICNVNHEPSNTEVDKKVEPKSCDKTHTCPPCPAPEL LGGPSVFLFPPKPKDTLMISRTPEVTCVVVDVSHEDPEVEFNWYVDGVEVHNAKTKPR EEQYNSTYRVVSVLTVLHQDWLNGKEYECEVSNEALPAPIEETISKAKGQPREPQVYTL PPSEEEMTKNQVSLTCLVKGFYPSDIAVEWESNGQPENNYETTPPVLDSDGSFFLYSKL TVDKSRWQQGNVFSCSVMHEALHNHYTQKSLSLSPG |
| SEQ ID NO: 178 | XENP010109 | IgG1/2-pI(7) | ASTKGPSVFPLAPSSESTSGGTAALGCLVKDYFPEPVTVSWNSGALTSGVHTFPAVLQ SSGLYSLSSVVTVPSSSLGTQTYICNVNHEPSNTEVDKKVEPKSCDKTHTCPPCPAPPV AGPSVFLFPPKPKDTLMISRTPEVTCVVVDVSHEDPEVEFNWYVDGVEVHNAKTKPRE EQFNSTFRVVSVLTVVHQDWLNGKEYKCKVSNKGLPAPIEKTISKTKGQPREPQVYTLP PSEEEMTKNQVSLTCLVKGFYPSDIAVEWESNGQPENNYETTPPMLDSDGSFFLYSKL TVDKSRWQQGNVFSCSVMHEALHNHYTQKSLSLSPG |

Figure 92 (cont.)

| | XenP | Patent name (HC) | Sequence |
|---|---|---|---|
| SEQ ID NO: 179 | XENP010110 | IgG1/2-pI(11) | ASTKGPSVFPLAPSSESTSGGTAALGCLVKDYFPEPVTVSWNSGALTSGVHTFPAVLQ SSGLYSLSSVVTVPSSSLGTQTYICNVNHEPSNTEVDKKVEPKSCDKTHTCPPCPAPPV AGPSVFLFPPKPKDTLMISRTPEVTCVVVDVSHEDPEVEFNWYVDGVEHNAKTKPRE EQFNSTFRVVSVLTVVHQDWLNGKEYECEVSNEGLPAPIEETISKTKGQPREPQVYTLP PSEEEMTKNQVSLTCLVKGFYPSDIAVEWESNGQPENNYETTPPMLDSDGSFFLYSKL TVDKSRWQQGNVFSCSVMHEALHNHYTQKSLSLSPG |
| SEQ ID NO: 180 | XENP010017 | IgG1-pI(6)-Neutral-to-DE | AETKGPSVFPLAPSSQSQSTSGGTAALGCLVKDYFPEPVTVSWNSGALESGVHTFPAVLQ SSGLYSLSSVVTVPSSSLGTQTYICNVNHKPSDTKVDKKVEPKSCDKTHTCPPCPAPEL LGGPSVFLFPPKPKDTLMISRTPEVTCVVVDVSHEDPEVKFNWYVDGVEVHNAKTKPR EEQYNSTYRVVSVLTVLHQDWLNGKEYKCKVSNKALPAPIEKTISKAKGQPREPQVYTL PPSREEMTKNQVSLTCLVKGFYPSDIAVEWESNGQPENNYKTTPPVLDSDGSFFLYSKL TVDKSRWQQGNVFSCSVMHEALHNHYTQKSLSLSPGK |
| SEQ ID NO: 181 | XENP010018 | IgG1-pI(6)-KR-to-Neutral | ASTKGPSVFPLAPSSQSQSTSGGTAALGCLVKDYFPEPVTVSWNSGALTSGVHTFPAVLQ SSGLYSLSSVVTVPSSSLGTQTYICNVNHQPSNTQVDKKVEPKSCDKTHTCPPCPAPEL LGGPSVFLFPPKPKDTLMISRTPEVTCVVVDVSHEDPEVKFNWYVDGVEVHNAKTKPR EEQYNSTYRVVSVLTVLHQDWLNGKEYKCKVSNKALPAPIEKTISKAKGQPREPQVYTL PPSREEMTKNQVSLTCLVKGFYPSDIAVEWESNGQPENNYKTTPPVLDSDGSFFLYSKL TVDKSRWQQGNVFSCSVMHEALHNHYTQKSLSLSPGK |
| SEQ ID NO: 182 | XENP010019 | IgG1-pI(6)-KR-to-DE | ASTKGPSVFPLAPSSESTSGGTAALGCLVKDYFPEPVTVSWNSGALTSGVHTFPAVLQ SSGLYSLSSVVTVPSSSLGTQTYICNVNHEPSNTEVDKKVEPKSCDKTHTCPPCPAPEL LGGPSVFLFPPKPKDTLMISRTPEVTCVVVDVSHEDPEVKFNWYVDGVEVHNAKTKPR EEQYNSTYRVVSVLTVLHQDWLNGKEYKCKVSNKALPAPIEKTISKAKGQPREPQVYTL PPSREEMTKNQVSLTCLVKGFYPSDIAVEWESNGQPENNYKTTPPVLDSDGSFFLYSKL TVDKSRWQQGNVFSCSVMHEALHNHYTQKSLSLSPGK |
| SEQ ID NO: 183 | XENP010178 | IgG-pI-Iso2 | ASTKGPSVFPLAPSSKSTSESTAALGCLVKDYFPEPVTVSWNSGALTSGVHTFPAVLQS SGLYSLSSVVTVPSSNFGTQTYTCNVDHKPSNTKVDKTVEPKSCVECPPCPAPPVAGP SVFLFPPKPKDTLMISRTPEVTCVVVDVSHEDPEVQFNWYVDGVEVHNAKTKPREEQF NSTFRVVSVLTVVHQDWLNGKEYKCKVSNKGLPAPIEKTISKTKGQPREPQVYTLPPSQ EEMTKNQVSLTCLVKGFYPSDIAVEWESNGQPENNYNTTPPMLDSDGSFFLYSKLTVD KSRWQEGNVFSCSVMHEALHNHYTQKSLSLSPG |
| SEQ ID NO: 184 | XENP010179 | IgG-pI-Iso3 | ASTKGPSVFPLAPSSKSTSESTAALGCLVKDYFPEPVTVSWNSGALTSGVHTFPAVLQS SGLYSLSSVVTVPSSNFGTQTYTCNVDHKPSNTKVDKTVEPKSCDTTHTCPPCPAPELL GGPSVFLFPPKPKDTLMISRTPEVTCVVVDVSHEDPEVQFNWYVDGVEVHNAKTKPRE EQFNSTFRVVSVLTVVHQDWLNGKEYKCKVSNKALPAPIEKTISKTKGQPREPQVYTLP PSQEEMTKNQVSLTCLVKGFYPSDIAVEWESSGQPENNYNTTPPMLDSDGSFFLYSKL TVDKSRWQEGNVFSCSVMHEALHNHYTQKSLSLSPG |

Figure 92 (cont.)

| | XenP | Patent name (HC) | Sequence |
|---|---|---|---|
| SEQ ID NO: 185 | XENP010180 | IgG-pI-Iso2-434S | ASTKGPSVFPLAPSSKSTSESTAALGCLVKDYFPEPVTVSWNSGALTSGVHTFPAVLQSSGLYSLSSVVTVPSSNFGTQTYTCNVDHKPSNTKVDKTVEPKSCVECPPCPAPPVAGPSVFLFPPKPKDTLMISRTPEVTCVVVDGVSHEDPEVQFNWYVDGVEVHNAKTKPREEQFNSTFRVVSVLTVVHQDWLNGKEYKCKVSNKGLPAPIEKTISKTKGQPREPQVYTLPPSQEEMTKNQVSLTCLVKGFYPSDIAVEWESSGQPENNYNTTPPMLDSDGSFFLYSKLTVDKSRWQEGNVFSCSVMHEALHSHYTQKSLSLSPG |
| SEQ ID NO: 186 | XENP010181 | IgG-pI-Iso3-434S | ASTKGPSVFPLAPSSKSTSESTAALGCLVKDYFPEPVTVSWNSGALTSGVHTFPAVLQSSGLYSLSSVVTVPSSNFGTQTYTCNVDHKPSNTKVDKTVEPKSCDTHTCPPCPAPELLGGPSVFLFPPKPKDTLMISRTPEVTCVVVDVSHEDPEVQFNWYVDGVEVHNAKTKPREEQFNSTFRVVSVLTVVHQDWLNGKEYKCKVSNKALPAPIEKTISKTKGQPREPQVYTLPPSQEEMTKNQVSLTCLVKGFYPSDIAVEWESSGQPENNYNTTPPMLDSDGSFFLYSKLTVDKSRWQEGNVFSCSVMHEALHNHYTQKSLSLSPG |
| SEQ ID NO: 187 | XENP010182 | IgG-pI-Iso2 | ASTKGPSVFPLAPSSKSTSESTAALGCLVKDYFPEPVTVSWNSGALTSGVHTFPAVLQSSGLYSLSSVVTVPSSNFGTQTYTCNVDHKPSNTKVDKTVEPKSCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSQEEMTKNQVSLTCLVKGFYPSDIAVEWESSGQPENNYNTTPPMLDSDGSFFLYSKLTVDKSRWQEGNVFSCSVMHEALHSHYTQKSLSLSPG |
| SEQ ID NO: 188 | XENP010183 | IgG-pI-Iso3 | ASTKGPSVFPLAPSSKSTSESTAALGCLVKDYFPEPVTVSWNSGALTSGVHTFPAVLQSSGLYSLSSVVTVPSSNFGTQTYTCNVDHKPSNTKVDKTVEPKSCDTHTCPPCPAPELLGGPSVFLFPPKPKDTLMISRTPEVTCVVVDVSHEDPEVQFNWYVDGVEVHNAKTKPREEQFNSTFRVVSVLTVVHQDWLNGKEYKCKVSNKALPAPIEKTISKTKGQPREPQVYTLPPSQEEMTKNQVSLTCLVKGFYPSDIAVEWESSGQPENNYNTTPPMLDSDGSFFLYSKLTVDKSRWQEGNVFSCSVMHEALHNHYTQKSLSLSPG |
| SEQ ID NO: 189 | XENP010184 | IgG-pI-Iso2-434S | ASTKGPSVFPLAPSSKSTSESTAALGCLVKDYFPEPVTVSWNSGALTSGVHTFPAVLQSSGLYSLSSVVTVPSSNFGTQTYTCNVDHKPSNTKVDKTVEPKSCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSQEEMTKNQVSLTCLVKGFYPSDIAVEWESSGQPENNYNTTPPMLDSDGSFFLYSKLTVDKSRWQEGNVFSCSVMHEALHSHYTQKSLSLSPG |
| SEQ ID NO: 190 | XENP010185 | IgG-pI-Iso3-434S | ASTKGPSVFPLAPSSKSTSESTAALGCLVKDYFPEPVTVSWNSGALTSGVHTFPAVLQSSGLYSLSSVVTVPSSNFGTQTYTCNVDHKPSNTKVDKTVEPKSCDTHTCPPCPAPELLGGPSVFLFPPKPKDTLMISRTPEVTCVVVDVSHEDPEVQFNWYVDGVEVHNAKTKPREEQFNSTFRVVSVLTVVHQDWLNGKEYKCKVSNKALPAPIEKTISKTKGQPREPQVYTLPPSQEEMTKNQVSLTCLVKGFYPSDIAVEWESSGQPENNYNTTPPMLDSDGSFFLYSKLTVDKSRWQEGNVFSCSVMHEALHNHYTQKSLSLSPG |

Figure 92 (cont.)

| | XenP | Patent name (HC) | Sequence |
|---|---|---|---|
| SEQ ID NO: 191 | XENP010265 | | ASTKGPSVFPLAPSSKSTSESTAALGCLVKDYFPEPVTVSWNSGALTSGVHTFPAVLQSSGLYSLSSVVTVPSSNFGTQTYTCNVDHKPSNTKVDKTVEPKSCDKTHTCPPCPAPELLGGPSVFLFPPKPKDTLMISRTPEVTCVVVDVSHEDPEVQFNWYVDGVEVHNAKTKPREEQFNSTFRVVSVLTVVHQDWLNGKEYKCKVSNKALPAPIEKTISKTKGQPREPQVYTLPPSQEEMTKNQVSLTCLVKGFYPSDIAVEWESSGQPENNYNTTPPMLDSDGSFFLYSKLTVDKSRWQEGNVFSCSVMHEALHNHYTQKSLSLSPG |
| SEQ ID NO: 192 | XENP010266 | | ASTKGPSVFPLAPSSKSTSESTAALGCLVKDYFPEPVTVSWNSGALTSGVHTFPAVLQSSGLYSLSSVVTVPSSNFGTQTYTCNVDHKPSNTKVDKTVEPKSCDTHTCPPCPAPELLGGPSVFLFPPKPKDTLMISRTPEVTCVVVDVSHEDPEVKFNWYVDGVEVHNAKTKPREEQFNSTFRVVSVLTVVHQDWLNGKEYKCKVSNKALPAPIEKTISKTKGQPREPQVYTLPPSQEEMTKNQVSLTCLVKGFYPSDIAVEWESSGQPENNYNTTPPMLDSDGSFFLYSKLTVDKSRWQEGNVFSCSVMHEALHNHYTQKSLSLSPG |
| SEQ ID NO: 193 | XENP010267 | | ASTKGPSVFPLAPSSKSTSESTAALGCLVKDYFPEPVTVSWNSGALTSGVHTFPAVLQSSGLYSLSSVVTVPSSNFGTQTYTCNVDHKPSNTKVDKTVEPKSCDTTHTCPPCPAPELLGGPSVFLFPPKPKDTLMISRTPEVTCVVVDVSHEDPEVQFNWYVDGVEVHNAKTKPREEQFNSTFRVVSVLTVVHQDWLNGKEYKCKVSNKALPAPIEKTISKTKGQPREPQVYTLPPSQEEMTKNQVSLTCLVKGFYPSDIAVEWESSGQPENNYNTTPPMLDSDGSFFLYSKLTVDKSRWQEGNVFSCSVMHEALHNHYTQKSLSLSPG |
| SEQ ID NO: 194 | XENP010268 | | ASTKGPSVFPLAPSSKSTSESTAALGCLVKDYFPEPVTVSWNSGALTSGVHTFPAVLQSSGLYSLSSVVTVPSSNFGTQTYTCNVDHKPSNTKVDKTVEPKSCDTTHTCPPCPAPELLGGPSVFLFPPKPKDTLMISRTPEVTCVVVDVSHEDPEVQFNWYVDGVEVHNAKTKPREEQYNSTFRVVSVLTVVHQDWLNGKEYKCKVSNKALPAPIEKTISKTKGQPREPQVYTLPPSQEEMTKNQVSLTCLVKGFYPSDIAVEWESSGQPENNYNTTPPMLDSDGSFFLYSKLTVDKSRWQEGNVFSCSVMHEALHNHYTQKSLSLSPG |
| SEQ ID NO: 195 | XENP010269 | | ASTKGPSVFPLAPSSKSTSESTAALGCLVKDYFPEPVTVSWNSGALTSGVHTFPAVLQSSGLYSLSSVVTVPSSNFGTQTYTCNVDHKPSNTKVDKTVEPKSCDTHTCPPCPAPELLGGPSVFLFPPKPKDTLMISRTFRVSVLTVLHQDWLNGKEYKCKVSNKALPAPIEKTISKTKGQPREPQVYTLPPSQEEMTKNQVSLTCLVKGFYPSDIAVEWESSGQPENNYNTTPPMLDSDGSFFLYSKLTVDKSRWQEGNVFSCSVMHEALHNHYTQKSLSLSPGASTKGPSVFPLAPSSKSTSESTAALGCLVKDYFPEPVTVSWNSGALTSGVHTFPAVLQSSGLYSLSSVVTVPSSNFGTQTYTCNVDHKPSNTKVDKTVEPKSCDTHTCPPCPAPELLGGPSVFLFPPKPKDTLMISRTPEVTCVVVDVSHEDPEVQFNWYVDGVEVHNAKTKPREEQFNSTFRVVSVLTVLHQDWLNGKEYKCKVSNKALPAPIEKTISKTKGQPREPQVYTLPPSQEEMTKNQVSLTCLVKGFYPSDIAVEWESSGQPENNYNTTPPMLDSDGSFFLYSKLTVDKSRWQEGNVFSCSVMHEALHNHYTQKSLSLSPG |

Figure 92 (cont.)

| | XenP | Patent name (HC) | Sequence |
|---|---|---|---|
| SEQ ID NO: 196 | XENP010270 | | ASTKGPSVFPLAPSSKSTSESTAALGCLVKDYFPEPVTVSWNSGALTSGVHTFPAVLQS SGLYSLSSVVTVPSSNFGTQTYTCNVDHKPSNTKVDKTVEPKSCDTTHTCPPCPAPELL GGPSVFLFPPKPKDTLMISRTPEVTCVVVDVSHEDPEVQFNWYVDGVEVHNAKTKPRE EQFNSTFRVVSVLTVVHQDWLNGKEYKCKVSNKALPAPIEKTISKAKGQREPQVYTLP PSQEEMTKNQVSLTCLVKGFYPSDIAVEWESSGQPENNYNTTPPMLDSDGSFFLYSKL TVDKSRWQEGNVFSCSVMHEALHNHYTQKSLSLSPG |
| SEQ ID NO: 197 | XENP010271 | | ASTKGPSVFPLAPSSKSTSESTAALGCLVKDYFPEPVTVSWNSGALTSGVHTFPAVLQS SGLYSLSSVVTVPSSNFGTQTYTCNVDHKPSNTKVDKTVEPKSCDTTHTCPPCPAPELL GGPSVFLFPPKPKDTLMISRTPEVTCVVVDVSHEDPEVQFNWYVDGVEVHNAKTKPRE EQFNSTFRVVSVLTVVHQDWLNGKEYKCKVSNKALPAPIEKTISKTKGQPREPQVYTLP PSREEMTKNQVSLTCLVKGFYPSDIAVEWESSGQPENNYNTTPPMLDSDGSFFLYSKL TVDKSRWQEGNVFSCSVMHEALHNHYTQKSLSLSPG |
| SEQ ID NO: 198 | XENP010272 | | ASTKGPSVFPLAPSSKSTSESTAALGCLVKDYFPEPVTVSWNSGALTSGVHTFPAVLQS SGLYSLSSVVTVPSSNFGTQTYTCNVDHKPSNTKVDKTVEPKSCDTTHTCPPCPAPELL GGPSVFLFPPKPKDTLMISRTPEVTCVVVDVSHEDPEVQFNWYVDGVEVHNAKTKPRE EQFNSTFRVVSVLTVVHQDWLNGKEYKCKVSNKALPAPIEKTISKTKGQPREPQVYTLP PSQEEMTKNQVSLTCLVKGFYPSDIAVEWESNGQPENNYNTTPPMLDSDGSFFLYSKL TVDKSRWQEGNVFSCSVMHEALHNHYTQKSLSLSPG |
| SEQ ID NO: 199 | XENP010273 | | ASTKGPSVFPLAPSSKSTSESTAALGCLVKDYFPEPVTVSWNSGALTSGVHTFPAVLQS SGLYSLSSVVTVPSSNFGTQTYTCNVDHKPSNTKVDKTVEPKSCDTTHTCPPCPAPELL GGPSVFLFPPKPKDTLMISRTPEVTCVVVDVSHEDPEVQFNWYVDGVEVHNAKTKPRE EQFNSTFRVVSVLTVVHQDWLNGKEYKCKVSNKALPAPIEKTISKTKGQPREPQVYTLP PSQEEMTKNQVSLTCLVKGFYPSDIAVEWESSGQPENNYKTTPPMLDSDGSFFLYSKL TVDKSRWQEGNVFSCSVMHEALHNHYTQKSLSLSPG |
| SEQ ID NO: 200 | XENP010274 | | ASTKGPSVFPLAPSSKSTSESTAALGCLVKDYFPEPVTVSWNSGALTSGVHTFPAVLQS SGLYSLSSVVTVPSSNFGTQTYTCNVDHKPSNTKVDKTVEPKSCDTTHTCPPCPAPELL GGPSVFLFPPKPKDTLMISRTPEVTCVVVDVSHEDPEVQFNWYVDGVEVHNAKTKPRE EQFNSTFRVVSVLTVVHQDWLNGKEYKCKVSNKALPAPIEKTISKTKGQPREPQVYTLP PSQEEMTKNQVSLTCLVKGFYPSDIAVEWESSGQPENNYNTTPPVLDSDGSFFLYSKLT VDKSRWQEGNVFSCSVMHEALHNHYTQKSLSLSPG |
| SEQ ID NO: 201 | XENP010275 | | ASTKGPSVFPLAPSSKSTSESTAALGCLVKDYFPEPVTVSWNSGALTSGVHTFPAVLQS SGLYSLSSVVTVPSSNFGTQTYTCNVDHKPSNTKVDKTVEPKSCDTTHTCPPCPAPELL GGPSVFLFPPKPKDTLMISRTPEVTCVVVDVSHEDPEVQFNWYVDGVEVHNAKTKPRE EQFNSTFRVVSVLTVVHQDWLNGKEYKCKVSNKALPAPIEKTISKTKGQPREPQVYTLP PSQEEMTKNQVSLTCLVKGFYPSDIAVEWESSGQPENNYNTTPPMLDSDGSFFLYSKL TVDKSRWQQGNVFSCSVMHEALHNHYTQKSLSLSPG |

Figure 92 (cont.)

| | XenP | Patent name (HC) | Sequence |
|---|---|---|---|
| SEQ ID NO: 202 | XENP010276 | | ASTKGPSVFPLAPSSKSTSESTAALGCLVKDYFPEPVTVSWNSGALTSGVHTFPAVLQS SGLYSLSSVVTVPSSNFGTQTYTCNVDHKPSNTKVDKTVEPKSCDTTHTCPPCPAPELL GGPSVFLFPPKPKDTLMISRTPEVTCVVVDVSHEDPEVQFNWYVDGVEVHNAKTKPRE EQYNSTYRVVSVLTVVHQDWLNGKEYKCKVSNKALPAPIEKTISKTKGQPREPQVYTLP PSQEEMTKNQVSLTCLVKGFYPSDIAVEWESNGQPENNYKTTPPMLDSDGSFFLYSKL TVDKSRWQEGNVFSCSVMHEALHNHYTQKSLSLSPG |
| SEQ ID NO: 203 | XENP010277 | | ASTKGPSVFPLAPSSKSTSESTAALGCLVKDYFPEPVTVSWNSGALTSGVHTFPAVLQS SGLYSLSSVVTVPSSNFGTQTYTCNVDHKPSNTKVDKTVEPKSCDTTHTCPPCPAPELL GGPSVFLFPPKPKDTLMISRTPEVTCVVVDVSHEDPEVQFNWYVDGVEVHNAKTKPRE EQFNSTFRVVSVLTVVHQDWLNGKEYKCKVSNKALPAPIEKTISKTKGQPREPQVYTLP PSQEEMTKNQVSLTCLVKGFYPSDIAVEWESNGQPENNYKTTPPVLDSDGSFFLYSKLT VDKSRWQEGNVFSCSVMHEALHNHYTQKSLSLSPG |
| SEQ ID NO: 204 | XENP010278 | | ASTKGPSVFPLAPSSKSTSGSTAALGCLVKDYFPEPVTVSWNSGALTSGVHTFPAVLQS SGLYSLSSVVTVPSSNFGTQTYTCNVDHKPSNTKVDKTVEPKSCDTTHTCPPCPAPELL GGPSVFLFPPKPKDTLMISRTPEVTCVVVDVSHEDPEVQFNWYVDGVEVHNAKTKPRE EQFNSTFRVVSVLTVVHQDWLNGKEYKCKVSNKALPAPIEKTISKTKGQPREPQVYTLP PSQEEMTKNQVSLTCLVKGFYPSDIAVEWESSGQPENNYNTTPPMLDSDGSFFLYSKL TVDKSRWQEGNVFSCSVMHEALHNHYTQKSLSLSPG |
| SEQ ID NO: 205 | XENP010279 | | ASTKGPSVFPLAPSSKSTSEGTAALGCLVKDYFPEPVTVSWNSGALTSGVHTFPAVLQS SGLYSLSSVVTVPSSNFGTQTYTCNVDHKPSNTKVDKTVEPKSCDTTHTCPPCPAPELL GGPSVFLFPPKPKDTLMISRTPEVTCVVVDVSHEDPEVQFNWYVDGVEVHNAKTKPRE EQFNSTFRVVSVLTVVHQDWLNGKEYKCKVSNKALPAPIEKTISKTKGQPREPQVYTLP PSQEEMTKNQVSLTCLVKGFYPSDIAVEWESSGQPENNYNTTPPMLDSDGSFFLYSKL TVDKSRWQEGNVFSCSVMHEALHNHYTQKSLSLSPG |
| SEQ ID NO: 206 | XENP010280 | | ASTKGPSVFPLAPSSKSTSESTAALGCLVKDYFPEPVTVSWNSGALTSGVHTFPAVLQS SGLYSLSSVVTVPSSSFGTQTYTCNVDHKPSNTKVDKTVEPKSCDTTHTCPPCPAPELL GGPSVFLFPPKPKDTLMISRTPEVTCVVVDVSHEDPEVQFNWYVDGVEVHNAKTKPRE EQFNSTFRVVSVLTVVHQDWLNGKEYKCKVSNKALPAPIEKTISKTKGQPREPQVYTLP PSQEEMTKNQVSLTCLVKGFYPSDIAVEWESSGQPENNYNTTPPMLDSDGSFFLYSKL TVDKSRWQEGNVFSCSVMHEALHNHYTQKSLSLSPG |
| SEQ ID NO: 207 | XENP010281 | | ASTKGPSVFPLAPSSKSTSESTAALGCLVKDYFPEPVTVSWNSGALTSGVHTFPAVLQS SGLYSLSSVVTVPSSNLGTQTYTCNVDHKPSNTKVDKTVEPKSCDTTHTCPPCPAPELL GGPSVFLFPPKPKDTLMISRTPEVTCVVVDVSHEDPEVQFNWYVDGVEVHNAKTKPRE EQFNSTFRVVSVLTVVHQDWLNGKEYKCKVSNKALPAPIEKTISKTKGQPREPQVYTLP PSQEEMTKNQVSLTCLVKGFYPSDIAVEWESSGQPENNYNTTPPMLDSDGSFFLYSKL TVDKSRWQEGNVFSCSVMHEALHNHYTQKSLSLSPG |

Figure 92 (cont.)

| | XenP | Patent name (HC) | Sequence |
|---|---|---|---|
| SEQ ID NO: 208 | XENP010282 | | ASTKGPSVFPLAPSSKSTSESTAALGCLVKDYFPEPVTVSWNSGALTSGVHTFPAVLQS SGLYSLSSVVTVPSSNFGTQTYICNVDHKPSNTKVDKTVEPKSCDTTHTCPPCPAPELL GGPSVFLFPPKPKDTLMISRTPEVTCVVVDVSHEDPEVQFNWYVDGVEVHNAKTKPRE EQFNSTFRVVSVLTVVHQDWLNGKEYKCKVSNKALPAPIEKTISKTKGQPREPQVYTLP PSQEEMTKNQVSLTCLVKGFYPSDIAVEWESSGQPENNYNTTPPMLDSDGSFFLYSKL TVDKSRWQEGNVFSCSVMHEALHNHYTQKSLSLSPG |
| SEQ ID NO: 209 | XENP010283 | | ASTKGPSVFPLAPSSKSTSESTAALGCLVKDYFPEPVTVSWNSGALTSGVHTFPAVLQS SGLYSLSSVVTVPSSNFGTQTYICNVNHKPSNTKVDKTVEPKSCDTTHTCPPCPAPELL GGPSVFLFPPKPKDTLMISRTPEVTCVVVDVSHEDPEVQFNWYVDGVEVHNAKTKPRE EQFNSTFRVVSVLTVVHQDWLNGKEYKCKVSNKALPAPIEKTISKTKGQPREPQVYTLP PSQEEMTKNQVSLTCLVKGFYPSDIAVEWESSGQPENNYNTTPPMLDSDGSFFLYSKL TVDKSRWQEGNVFSCSVMHEALHNHYTQKSLSLSPG |
| SEQ ID NO: 210 | XENP010284 | | ASTKGPSVFPLAPSSKSTSESTAALGCLVKDYFPEPVTVSWNSGALTSGVHTFPAVLQS SGLYSLSSVVTVPSSNFGTQTYTCNVDHKKVEPKSCDTTHTCPPCPAPELL GGPSVFLFPPKPKDTLMISRTPEVTCVVVDVSHEDPEVQFNWYVDGVEVHNAKTKPRE EQFNSTFRVVSVLTVVHQDWLNGKEYKCKVSNKALPAPIEKTISKTKGQPREPQVYTLP PSQEEMTKNQVSLTCLVKGFYPSDIAVEWESSGQPENNYNTTPPMLDSDGSFFLYSKL TVDKSRWQEGNVFSCSVMHEALHNHYTQKSLSLSPG |
| SEQ ID NO: 211 | XENP010285 | | ASTKGPSVFPLAPSSKSTSGGTAALGCLVKDYFPEPVTVSWNSGALTSGVHTFPAVLQ SSGLYSLSSVVTVPSSNFGTQTYTCNVDHKPSNTKVDKTVEPKSCDTTHTCPPCPAPEL LGGPSVFLFPPKPKDTLMISRTPEVTCVVVDVSHEDPEVQFNWYVDGVEVHNAKTKPR EEQFNSTFRVVSVLTVVHQDWLNGKEYKCKVSNKALPAPIEKTISKTKGQPREPQVYTL PPSQEEMTKNQVSLTCLVKGFYPSDIAVEWESSGQPENNYNTTPPMLDSDGSFFLYSK LTVDKSRWQEGNVFSCSVMHEALHNHYTQKSLSLSPG |
| SEQ ID NO: 212 | XENP010286 | IgG-pI-Iso3-SL | ASTKGPSVFPLAPSSKSTSESTAALGCLVKDYFPEPVTVSWNSGALTSGVHTFPAVLQS SGLYSLSSVVTVPSSSLGTQTYTCNVDHKPSNTKVDKTVEPKSCDTTHTCPPCPAPELL GGPSVFLFPPKPKDTLMISRTPEVTCVVVDVSHEDPEVQFNWYVDGVEVHNAKTKPRE EQFNSTFRVVSVLTVVHQDWLNGKEYKCKVSNKALPAPIEKTISKTKGQPREPQVYTLP PSQEEMTKNQVSLTCLVKGFYPSDIAVEWESSGQPENNYNTTPPMLDSDGSFFLYSKL TVDKSRWQEGNVFSCSVMHEALHNHYTQKSLSLSPG |
| SEQ ID NO: 213 | XENP010287 | | ASTKGPSVFPLAPSSKSTSESTAALGCLVKDYFPEPVTVSWNSGALTSGVHTFPAVLQS SGLYSLSSVVTVPSSNFGTQTYICNVNHKPSNTKVDKTVEPKSCDTTHTCPPCPAPELL GGPSVFLFPPKPKDTLMISRTPEVTCVVVDVSHEDPEVQFNWYVDGVEVHNAKTKPRE EQFNSTFRVVSVLTVVHQDWLNGKEYKCKVSNKALPAPIEKTISKTKGQPREPQVYTLP PSQEEMTKNQVSLTCLVKGFYPSDIAVEWESSGQPENNYNTTPPMLDSDGSFFLYSKL TVDKSRWQEGNVFSCSVMHEALHNHYTQKSLSLSPG |

Figure 92 (cont.)

| | XenP | Patent name (HC) | Sequence |
|---|---|---|---|
| SEQ ID NO: 214 | XENP010288 | | ASTKGPSVFPLAPSSKSTSESTAALGCLVKDYFPEPVTVSWNSGALTSGVHTFPAVLQS SGLYSLSSVVTVPSSNFGTQTYTCNVDHKPSNTKVDKKVEPKSCDKTHTCPPCPAPELL GGPSVFLFPPKPKDTLMISRTPEVTCVVVDVSHEDPEVQFNWYVDGVEVHNAKTKPRE EQFNSTFRVVSVLTVVHQDWLNGKEYKCKVSNKALPAPIEKTISKTKGQPREPQVYTLP PSQEEMTKNQVSLTCLVKGFYPSDIAVEWESSGQPENNYNTTPPMLDSDGSFFLYSKL TVDKSRWQEGNVFSCSVMHEALHNHYTQKSLSLSPG |
| SEQ ID NO: 215 | XENP010289 | | ASTKGPSVFPLAPSSKSTSEGTAALGCLVKDYFPEPVTVSWNSGALTSGVHTFPAVLQS SGLYSLSSVVTVPSSSLGTQTYTCNVDHKPSNTKVDKTVEPKSCDTTHTCPPCPAPELL GGPSVFLFPPKPKDTLMISRTPEVTCVVVDVSHEDPEVQFNWYVDGVEVHNAKTKPRE EQFNSTFRVVSVLTVVHQDWLNGKEYKCKVSNKALPAPIEKTISKTKGQPREPQVYTLP PSQEEMTKNQVSLTCLVKGFYPSDIAVEWESSGQPENNYNTTPPMLDSDGSFFLYSKL TVDKSRWQEGNVFSCSVMHEALHNHYTQKSLSLSPG |
| SEQ ID NO: 216 | XENP010290 | | ASTKGPSVFPLAPSSKSTSGGTAALGCLVKDYFPEPVTVSWNSGALTSGVHTFPAVLQ SSGLYSLSSVVTVPSSSLGTQTYTCNVDHKPSNTKVDKTVEPKSCDTTHTCPPCPAPEL LGGPSVFLFPPKPKDTLMISRTPEVTCVVVDVSHEDPEVQFNWYVDGVEVHNAKTKPR EEQFNSTFRVVSVLTVVHQDWLNGKEYKCKVSNKALPAPIEKTISKTKGQPREPQVYTL PPSQEEMTKNQVSLTCLVKGFYPSDIAVEWESSGQPENNYNTTPPMLDSDGSFFLYSK LTVDKSRWQEGNVFSCSVMHEALHNHYTQKSLSLSPG |
| SEQ ID NO: 217 | XENP010324 | IgG-pI-Iso3 | ASTKGPSVFPLAPSSKSTSESTAALGCLVKDYFPEPVTVSWNSGALTSGVHTFPAVLQS SGLYSLSSVVTVPSSNFGTQTYTCNVDHKPSNTKVDKTVEPKSCDTTHTCPPCPAPELL GGPSVFLFPPKPKDTLMISRTPEVTCVVVDVSHEDPEVQFNWYVDGVEVHNAKTKPRE EQFNSTFRVVSVLTVVHQDWLNGKEYKCKVSNKALPAPIEKTISKTKGQPREPQVYTLP PSQEEMTKNQVSLTCLVKGFYPSDIAVEWESSGQPENNYNTTPPMLDSDGSFFLYSKL TVDKSRWQEGNVFSCSVMHEALHNHYTQKSLSLSPG |
| SEQ ID NO: 218 | XENP010325 | IgG-pI-Iso3 | ASTKGPSVFPLAPSSKSTSESTAALGCLVKDYFPEPVTVSWNSGALTSGVHTFPAVLQS SGLYSLSSVVTVPSSNFGTQTYTCNVDHKPSNTKVDKTVEPKSCDTTHTCPPCPAPELL GGPSVFLFPPKPKDTLMISRTPEVTCVVVDVSHEDPEVQFNWYVDGVEVHNAKTKPRE EQFNSTFRVVSVLTVVHQDWLNGKEYKCKVSNKALPAPIEKTISKTKGQPREPQVYTLP PSQEEMTKNQVSLTCLVKGFYPSDIAVEWESSGQPENNYNTTPPMLDSDGSFFLYSKL TVDKSRWQEGNVFSCSVMHEALHNHYTQKSLSLSPG |
| SEQ ID NO: 219 | XENP010326 | IgG-pI-Iso3 | ASTKGPSVFPLAPSSKSTSESTAALGCLVKDYFPEPVTVSWNSGALTSGVHTFPAVLQS SGLYSLSSVVTVPSSNFGTQTYTCNVDHKPSNTKVDKTVEPKSCDTTHTCPPCPAPELL GGPSVFLFPPKPKDTLMISRTPEVTCVVVDVSHEDPEVQFNWYVDGVEVHNAKTKPRE EQFNSTFRVVSVLTVVHQDWLNGKEYKCKVSNKALPAPIEKTISKTKGQPREPQVYTLP PSQEEMTKNQVSLTCLVKGFYPSDIAVEWESSGQPENNYNTTPPMLDSDGSFFLYSKL TVDKSRWQEGNVFSCSVMHEALHNHYTQKSLSLSPG |

Figure 92 (cont.)

| | XenP | Patent name (HC) | Sequence |
|---|---|---|---|
| SEQ ID NO: 220 | XENP010327 | IgG-pI-Iso3 | ASTKGPSVFPLAPSSKSTSESTAALGCLVKDYFPEPVTVSWNSGALTSGVHTFPAVLQSSGLYSLSSVVTVPSSNFGTQTYTCNVDHKPSNTKVDKTVEPKSCDTTHTCPPCPAPELLGGPSVFLFPPKPKDTLMISRTPEVTCVVVDVSHEDPEVQFNWYVDGVEVHNAKTKPREEQFNSTFRVVSVLTVVHQDWLNGKEYKCKVSNKALPAPIEKTISKTKGQPREPQVYTLPPSQEEMTKNQVSLTCLVKGFYPSDIAVEWESSGQPENNYNTTPPMLDSDGSFFLYSKLTVDKSRWQEGNVFSCSVMHEALHNHYTQKSLSLSPG |
| SEQ ID NO: 221 | XENP010425 | | ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK |
| SEQ ID NO: 222 | XENP010426 | IgG-pI-Iso3-charges-only | ASTKGPSVFPLAPSSKSTSESTAALGCLVKDYFPEPVTVSWNSGALTSGVHTFPAVLQSSGLYSLSSVVTVPSSSLGTQTYICNVDHKPSNTKVDKTVEPKSCDTTHTCPPCPAPELLGGPSVFLFPPKPKDTLMISRTPEVTCVVVDVSHEDPEVQFNWYVDGVEVHNAKTKPREEQYNSTYRVVSVLTVLHQDWLNGKEYKCKVSNKGLPAPIEKTISKAKGQPREPQVYTLPPSQEEMTKNQVSLTCLVKGFYPSDIAVEWESNGQPENNYNTTPPVLDSDGSFFLYSKLTVDKSRWQEGNVFSCSVMHEALHNHYTQKSLSLSPG |
| SEQ ID NO: 223 | XENP010427 | IgG-pI-Iso2-charges-only | ASTKGPSVFPLAPSSKSTSESTAALGCLVKDYFPEPVTVSWNSGALTSGVHTFPAVLQSSGLYSLSSVVTVPSSNFGTQTYTCNVDHKPSNTKVDKTVEPKSCVECPPCPAPPVAGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPAPIEKTISKAKGQPREPQVYTLPPSQEEMTKNQVSLTCLVKGFYPSDIAVEWESNGQPENNYKTTPPVLDSDGSFFLYSKLTVDKSRWQEGNVFSCSVMHEALHNHYTQKSLSLSPG |
| SEQ ID NO: 224 | XENP010428 | | ASTKGPSVFPLAPSSKSRSTSESTAALGCLVKDYFPEPVTVSWNSGALTSGVHTFPAVLQSSGLYSLSSVVTVPSSNFGTQTYTCNVDHKPSNTKVDKTVERKSCDKTHTCPPCPAPELLGGPSVFLFPPKPKDTLMISRTPEVTCVVVDVSHEDPEVKFNWYVDGVEVHNAKTKPREEQFNSTFRVVSVLTVVHQDWLNGKEYKCKVSNKALPAPIEKTISKAKGQPREPQVYTLPPSREEMTKNQVSLTCLVKGFYPSDIAVEWESSGQPENNYKTTPPVLDSDGSFFLYSKLTVDKSRWQQGNVFSCSVMHEALHNHYTQKSLSLSPGK |
| SEQ ID NO: 225 | XENP010466 | IgG-pI-Iso3-SL-434S | ASTKGPSVFPLAPSSKSTSESTAALGCLVKDYFPEPVTVSWNSGALTSGVHTFPAVLQSSGLYSLSSVVTVPSSNFGTQTYTCNVDHKPSNTKVDKTVEPKSCDTTHTCPPCPAPELLGGPSVFLFPPKPKDTLMISRTPEVTCVVVDVSHEDPEVQFNWYVDGVEVHNAKTKPREEQFNSTFRVVSVLTVVHQDWLNGKEYKCKVSNKALPAPIEKTISKTKGQPREPQVYTLPPSQEEMTKNQVSLTCLVKGFYPSDIAVEWESSGQPENNYNTTPPMLDSDGSFFLYSKLTVDKSRWQEGNVFSCSVMHEALHSHYTQKSLSLSPG |

Figure 92 (cont.)

| | XenP | Patent name (HC) | Sequence |
|---|---|---|---|
| SEQ ID NO: 226 | XENP010467 | IgG-pI-Iso3-SL-428L/434S | ASTKGPSVFPLAPSSKSTSESTAALGCLVKDYFPEPVTVSWNSGALTSGVHTFPAVLQS SGLYSLSSVVTVPSSSLGTQTYTCNVDHKPSNTKVDKTVEPKSCDTTHTCPPCPAPELL GGPSVFLFPPKPKDTLMISRTPEVTCVVVDVSHEDPEVQFNWYVDGVEVHNAKTKPRE EQFNSTFRVVSVLTVVHQDWLNGKEYKCKVSNKALPAPIEKTISKTKGQPREPQVYTLP PSQEEMTKNQVSLTCLVKGFYPSDIAVEWESSGQPENNYNTTPPMLDSDGSFFLYSKL TVDKSRWQEGNVFSCSVLHEALHSHYTQKSLSLSPG |
| SEQ ID NO: 227 | XENP010468 | | ASTKGPSVFPLAPSSKSTSESTAALGCLVKDYFPEPVTVSWNSGALTSGVHTFPAVLQS SGLYSLSSVVTVPSSSLGTQTYTCNVDHKPSNTKVDKTVEPKSCDTTHTCPPCPAPELL GGPSVFLFPPKPKDTLMISRTPEVTCVVVDVSHEDPEVQFNWYVDGVEVHNAKTKPRE EQFNSTFRVVSVLTVVHQDWLNGKEYKCKVSNKALPAPIEKTISKTKGQPREPQVYTLP PSQEEMTKNQVSLTCLVKGFYPSDIAVEWESSGQPENNYNTTPPMLDSDGSFFLYSK TVDKSRWQEGNVFSCSVMHEALHSHYTQKSLSLSPG |
| SEQ ID NO: 228 | XENP010469 | | ASTKGPSVFPLAPSSKSTSGGTAALGCLVKDYFPEPVTVSWNSGALTSGVHTFPAVLQ SSGLYSLSSVVTVPSSSLGTQTYTCNVDHKPSNTKVDKTVEPKSCDTTHTCPPCPAPEL LGGPSVFLFPPKPKDTLMISRTPEVTCVVVDVSHEDPEVQFNWYVDGVEVHNAKTKPR EEQFNSTFRVVSVLTVVHQDWLNGKEYKCKVSNKALPAPIEKTISKTKGQPREPQVYTL PPSQEEMTKNQVSLTCLVKGFYPSDIAVEWESSGQPENNYNTTPPMLDSDGSFFLYSK LTVDKSRWQEGNVFSCSVMHEALHNHYTQKSLSLSPG |
| SEQ ID NO: 229 | XENP010470 | IgG-pI-Iso2-SL | ASTKGPSVFPLAPSSKSTSESTAALGCLVKDYFPEPVTVSWNSGALTSGVHTFPAVLQS SGLYSLSSVVTVPSSSLGTQTYTCNVDHKPSNTKVDKTVEPKSCVECPPCPAPPVAGP SVFLFPPKPKDTLMISRTPEVTCVVVDVSHEDPEVQFNWYVDGVEVHNAKTKPREEQF NSTFRVVSVLTVVHQDWLNGKEYKCKVSNKGLPAPIEKTISKTKGQPREPQVYTLPPSQ EEMTKNQVSLTCLVKGFYPSDIAVEWESSGQPENNYNTTPPMLDSDGSFFLYSKLTVD KSRWQEGNVFSCSVMHEALHNHYTQKSLSLSPG |
| SEQ ID NO: 230 | XENP010471 | IgG-pI-Iso2-SL-434S | ASTKGPSVFPLAPSSKSTSESTAALGCLVKDYFPEPVTVSWNSGALTSGVHTFPAVLQS SGLYSLSSVVTVPSSSLGTQTYTCNVDHKPSNTKVDKTVEPKSCVECPPCPAPPVAGP SVFLFPPKPKDTLMISRTPEVTCVVVDVSHEDPEVQFNWYVDGVEVHNAKTKPREEQF NSTFRVVSVLTVVHQDWLNGKEYKCKVSNKGLPAPIEKTISKTKGQPREPQVYTLPPSQ EEMTKNQVSLTCLVKGFYPSDIAVEWESSGQPENNYNTTPPMLDSDGSFFLYSKLTVD KSRWQEGNVFSCSVMHEALHNHYTQKSLSLSPG |
| SEQ ID NO: 231 | XENP010472 | IgG-pI-Iso3-charges-only-434S | ASTKGPSVFPLAPSSKSTSGGTAALGCLVKDYFPEPVTVSWNSGALTSGVHTFPAVLQS SGLYSLSSVVTVPSSSLGTQTYICNVDHKPSNTKVDKTVEPKSCDTTHTCPPCPAPELL GGPSVFLFPPKPKDTLMISRTPEVTCVVVDVSHEDPEVQFNWYVDGVEVHNAKTKPRE EQYNSTYRVVSVLTVLHQDWLNGKEYKCKVSNKALPAPIEKTISKAKGQPREPQVYTLP PSQEEMTKNQVSLTCLVKGFYPSDIAVEWESNGQPENNYNTTPPVLDSDGSFFLYSKL TVDKSRWQEGNVFSCSVMHEALHSHYTQKSLSLSPG |

Figure 92 (cont.)

| XenP | Patent name (HC) | Sequence |
|---|---|---|
| SEQ ID NO: 232 | XENP010473 | IgG-pI-Iso2-charges-only-434S | ASTKGPSVFPLAPSSKSTSEGTAALGCLVKDYFPEPVTVSWNSGALTSGVHTFPAVLQSSGLYSLSSVVTVPSSSLGTQTYICNVDHKPSNTKVDKTVEPKSCVECPPCPAPPVAGPSVFLFPPKPKDTLMISRTPEVTCVVVDVSHEDPEVQFNWYVDGVEVHNAKTKPREEQYNSTYRVVSVLTVLHQDWLNGKEYKCKVSNKGLPAPIEKTISKAKGQPREPQVYTLPPSREEMTKNQVSLTCLVKGFYPSDIAVEWESNGQPENNYNTTPPVLDSDGSFFLYSKLTVDKSRWQEGNVFSCSVMHEALHSHYTQKSLSLSPG |
| SEQ ID NO: 233 | XENP010474 | | ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHSHYTQKSLSLSPGK |
| SEQ ID NO: 234 | XENP010475 | | ASTKGPSVFPLAPSSRSTSESTAALGCLVKDYFPEPVTVSWNSGALTSGVHTFPAVLQSSGLYSLSSVVTVPSSNFGTQTYTCNVDHKPSNTKVDKTVERKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHSHYTQKSLSLSPGK |
| SEQ ID NO: 235 | XENP010476 | IgG1_pI(7)-434S | ASTKGPSVFPLAPSSESTSGGTAALGCLVKDYFPEPVTVSWNSGALTSGVHTFPAVLQSSGLYSLSSVVTVPSSSLGTQTYICNVNHEPSNTEVDKKVEPKSCDKTHTCPPCPAPELLGGPSVFLFPPKPKDTLMISRTPEVTCVVVDVSHEDPEVEFNWYVDGVEVHNAKTKPREEQYNSTYRVVSVLTVLHQDWLNGKEYKCKVSNKALPAPIEKTISKAKGQPREPQVYTLPPSEEEMTKNQVSLTCLVKGFYPSDIAVEWESNGQPENNYETTPPMLDSDGSFFLYSKLTVDKSRWQQGNVFSCSVMHEALHSHYTQKSLSLSPG |
| SEQ ID NO: 236 | XENP010477 | IgG1/2_pI(7)-434S | ASTKGPSVFPLAPSSESTSGGTAALGCLVKDYFPEPVTVSWNSGALTSGVHTFPAVLQSSGLYSLSSVVTVPSSSLGTQTYICNVNHEPSNTEVDKKVEPKSCDKTHTCPPCPAPPVAGPSVFLFPPKPKDTLMISRTPEVTCVVVDVSHEDPEVEFNWYVDGVEVHNAKTKPREEQFNSTFRVVSVLTVVHQDWLNGKEYKCKVSNKGLPAPIEKTISKTKGQPREPQVYTLPPSEEEMTKNQVSLTCLVKGFYPSDIAVEWESNGQPENNYETTPPMLDSDGSFFLYSKLTVDKSRWQQGNVFSCSVMHEALHSHYTQKSLSLSPG |
| SEQ ID NO: 237 | XENP010478 | | ASTKGPSVFPLAPSSKSTSEGTAALGCLVKDYFPEPVTVSWNSGALTSGVHTFPAVLQSSGLYSLSSVVTVPSSSLGTQTYICNVDHKPSNTKVDKTVEPKSCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSEEEMTKNQVSLTCLVKGFYPSDIAVEWESNGQPENNYETTPPMLDSDGSFFLYSKLTVDKSRWQEGNVFSCSVMHEALHNHYTQKSLSLSPG |

Figure 92 (cont.)

| | XenP | Patent name (HC) | Sequence |
|---|---|---|---|
| SEQ ID NO: 238 | XENP010511 | IgG-pI-Iso3-SL | ASTKGPSVFPLAPSSKSTSESTAALGCLVKDYFPEPVTVSWNSGALTSGVHTFPAVLQS SGLYSLSSVVTVPSSSLGTQTYTCNVDHKPSNTKVDKTVEPKSCDTTHTCPPCPAPELL GGPSVFLFPPKPKDTLMISRTPEVTCVVVDVSHEDPEVQFNWYVDGVEVHNAKTKPRE EQFNSTFRVVSVLTVVHQDWLNGKEYKCKVSNKALPAPIEKTISKTKGQPREPQVYTLP PSQEEMTKNQVSLTCLVKGFYPSDIAVEWESSGQPENNYNTTPPMLDSDGSFFLYSKL TVDKSRWQEGNVFSCSVMHEALHNHYTQKSLSLSPG |
| SEQ ID NO: 239 | XENP010512 | IgG-pI-Iso3-SL | ASTKGPSVFPLAPSSKSTSESTAALGCLVKDYFPEPVTVSWNSGALTSGVHTFPAVLQS SGLYSLSSVVTVPSSSLGTQTYTCNVDHKPSNTKVDKTVEPKSCDTTHTCPPCPAPELL GGPSVFLFPPKPKDTLMISRTPEVTCVVVDVSHEDPEVQFNWYVDGVEVHNAKTKPRE EQFNSTFRVVSVLTVVHQDWLNGKEYKCKVSNKALPAPIEKTISKTKGQPREPQVYTLP PSQEEMTKNQVSLTCLVKGFYPSDIAVEWESSGQPENNYNTTPPMLDSDGSFFLYSKL TVDKSRWQEGNVFSCSVMHEALHNHYTQKSLSLSPG |
| SEQ ID NO: 240 | XENP010513 | IgG-pI-Iso3-SL | ASTKGPSVFPLAPSSKSTSESTAALGCLVKDYFPEPVTVSWNSGALTSGVHTFPAVLQS SGLYSLSSVVTVPSSSLGTQTYTCNVDHKPSNTKVDKTVEPKSCDTTHTCPPCPAPELL GGPSVFLFPPKPKDTLMISRTPEVTCVVVDVSHEDPEVQFNWYVDGVEVHNAKTKPRE EQFNSTFRVVSVLTVVHQDWLNGKEYKCKVSNKALPAPIEKTISKTKGQPREPQVYTLP PSQEEMTKNQVSLTCLVKGFYPSDIAVEWESSGQPENNYNTTPPMLDSDGSFFLYSKL TVDKSRWQEGNVFSCSVMHEALHNHYTQKSLSLSPG |
| SEQ ID NO: 241 | XENP010517 | IgG-pI-Iso3-SL-434S | ASTKGPSVFPLAPSSKSTSESTAALGCLVKDYFPEPVTVSWNSGALTSGVHTFPAVLQS SGLYSLSSVVTVPSSSLGTQTYTCNVDHKPSNTKVDKTVEPKSCDTTHTCPPCPAPELL GGPSVFLFPPKPKDTLMISRTPEVTCVVVDVSHEDPEVQFNWYVDGVEVHNAKTKPRE EQFNSTFRVVSVLTVVHQDWLNGKEYKCKVSNKALPAPIEKTISKTKGQPREPQVYTLP PSQEEMTKNQVSLTCLVKGFYPSDIAVEWESSGQPENNYNTTPPMLDSDGSFFLYSKL TVDKSRWQEGNVFSCSVMHEALHSHYTQKSLSLSPG |
| SEQ ID NO: 242 | XENP010518 | IgG-pI-Iso3-SL-434S | ASTKGPSVFPLAPSSKSTSESTAALGCLVKDYFPEPVTVSWNSGALTSGVHTFPAVLQS SGLYSLSSVVTVPSSSLGTQTYTCNVDHKPSNTKVDKTVEPKSCDTTHTCPPCPAPELL GGPSVFLFPPKPKDTLMISRTPEVTCVVVDVSHEDPEVQFNWYVDGVEVHNAKTKPRE EQFNSTFRVVSVLTVVHQDWLNGKEYKCKVSNKALPAPIEKTISKTKGQPREPQVYTLP PSQEEMTKNQVSLTCLVKGFYPSDIAVEWESSGQPENNYNTTPPMLDSDGSFFLYSKL TVDKSRWQEGNVFSCSVMHEALHSHYTQKSLSLSPG |
| SEQ ID NO: 243 | XENP010519 | IgG-pI-Iso3-SL-434S | ASTKGPSVFPLAPSSKSTSESTAALGCLVKDYFPEPVTVSWNSGALTSGVHTFPAVLQS SGLYSLSSVVTVPSSSLGTQTYTCNVDHKPSNTKVDKTVEPKSCDTTHTCPPCPAPELL GGPSVFLFPPKPKDTLMISRTPEVTCVVVDVSHEDPEVQFNWYVDGVEVHNAKTKPRE EQFNSTFRVVSVLTVVHQDWLNGKEYKCKVSNKALPAPIEKTISKTKGQPREPQVYTLP PSQEEMTKNQVSLTCLVKGFYPSDIAVEWESSGQPENNYNTTPPMLDSDGSFFLYSKL TVDKSRWQEGNVFSCSVMHEALHSHYTQKSLSLSPG |

Figure 92 (cont.)

| | XenP | Patent name (HC) | Sequence |
|---|---|---|---|
| SEQ ID NO: 244 | XENP010520 | IgG-pI-Iso3-SL-428L/434S | ASTKGPSVFPLAPSSKSTSESTAALGCLVKDYFPEPVTVSWNSGALTSGVHTFPAVLQS SGLYSLSSVVTVPSSSLGTQTYTCNVDHKPSNTKVDKTVEPKSCDTHTCPPCPAPELL GGPSVFLFPPKPKDTLMISRTPEVTCVVVDVSHEDPEVQFNWYVDGVEHNAKTKPRE EQFNSTFRVVSVLTVVHQDWLNGKEYKCKVSNKALPAPIEKTISKTKGQREPQVYTLP PSQEEMTKNQVSLTCLVKGFYPSDIAVEWESSGQPENNYNTTPPMLDSDGSFFLYSKL TVDKSRWQEGNVFSCSVLHEALHSHYTQKSLSLSPG |
| SEQ ID NO: 245 | XENP010521 | IgG-pI-Iso3-SL-428L/434S | ASTKGPSVFPLAPSSKSTSESTAALGCLVKDYFPEPVTVSWNSGALTSGVHTFPAVLQS SGLYSLSSVVTVPSSSLGTQTYTCNVDHKPSNTKVDKTVEPKSCDTTHTCPPCPAPELL GGPSVFLFPPKPKDTLMISRTPEVTCVVVDVSHEDPEVQFNWYVDGVEVHNAKTKPRE EQFNSTFRVVSVLTVVHQDWLNGKEYKCKVSNKALPAPIEKTISKTKGQREPQVYTLP PSQEEMTKNQVSLTCLVKGFYPSDIAVEWESSGQPENNYNTTPPMLDSDGSFFLYSKL TVDKSRWQEGNVFSCSVLHEALHSHYTQKSLSLSPG |
| SEQ ID NO: 246 | XENP010522 | IgG-pI-Iso3-SL-428L/434S | ASTKGPSVFPLAPSSKSTSESTAALGCLVKDYFPEPVTVSWNSGALTSGVHTFPAVLQS SGLYSLSSVVTVPSSSLGTQTYTCNVDHKPSNTKVDKTVEPKSCDTTHTCPPCPAPELL GGPSVFLFPPKPKDTLMISRTPEVTCVVVDVSHEDPEVQFNWYVDGVEVHNAKTKPRE EQFNSTFRVVSVLTVVHQDWLNGKEYKCKVSNKALPAPIEKTISKTKGQREPQVYTLP PSQEEMTKNQVSLTCLVKGFYPSDIAVEWESSGQPENNYNTTPPMLDSDGSFFLYSKL TVDKSRWQEGNVFSCSVMHEALHSHYTQKSLSLSPG |
| SEQ ID NO: 247 | XENP010525 | IgG-pI-Iso3-SL-434S | ASTKGPSVFPLAPSSKSTSESTAALGCLVKDYFPEPVTVSWNSGALTSGVHTFPAVLQS SGLYSLSSVVTVPSSNFGTQTYTCNVDHKPSNTKVDKTVEPKSCDTTHTCPPCPAPELL GGPSVFLFPPKPKDTLMISRTPEVTCVVVDVSHEDPEVQFNWYVDGVEVHNAKTKPRE EQFNSTFRVVSVLTVVHQDWLNGKEYKCKVSNKALPAPIEKTISKTKGQREPQVYTLP PSQEEMTKNQVSLTCLVKGFYPSDIAVEWESSGQPENNYNTTPPMLDSDGSFFLYSKL TVDKSRWQEGNVFSCSVMHEALHSHYTQKSLSLSPG |
| SEQ ID NO: 248 | XENP010526 | IgG-pI-Iso3-434S | ASTKGPSVFPLAPSSKSTSESTAALGCLVKDYFPEPVTVSWNSGALTSGVHTFPAVLQS SGLYSLSSVVTVPSSNFGTQTYTCNVDHKPSNTKVDKTVEPKSCDTTHTCPPCPAPELL GGPSVFLFPPKPKDTLMISRTPEVTCVVVDVSHEDPEVQFNWYVDGVEVHNAKTKPRE EQFNSTFRVVSVLTVVHQDWLNGKEYKCKVSNKALPAPIEKTISKTKGQREPQVYTLP PSQEEMTKNQVSLTCLVKGFYPSDIAVEWESSGQPENNYNTTPPMLDSDGSFFLYSKL TVDKSRWQEGNVFSCSVMHEALHSHYTQKSLSLSPG |
| SEQ ID NO: 249 | XENP010527 | IgG-pI-Iso2-SL-434S | ASTKGPSVFPLAPSSKSTSESTAALGCLVKDYFPEPVTVSWNSGALTSGVHTFPAVLQS SGLYSLSSVVTVPSSSLGTQTYTCNVDHKPSNTKVDKTVEPKSCVECPPCSVAPPVAGP SVFLFPPKPKDTLMISRTPEVTCVVVDVSHEDPEVQFNWYVDGVEVHNAKTKPREEQF NSTFRVVSVLTVVHQDWLNGKEYKCKVSNKGLPAPIEKTISKTKGQREPQVYTLPPSQ EEMTKNQVSLTCLVKGFYPSDIAVEWESSGQPENNYNTTPPMLDSDGSFFLYSKLTVD KSRWQEGNVFSCSVMHEALHSHYTQKSLSLSPG |

Figure 92 (cont.)

| | XenP | Patent name (HC) | Sequence |
|---|---|---|---|
| SEQ ID NO: 250 | XENP010589 | IgG-pI-CH1-v4 | AETKGPSVFPLAPSSESTSGGTAALGCLVKDYFPEPVTVSWNSGALESGVHTFPAVLQSSGLYSLSSVVTVPSSSLGTQTYICNVNHKPSDTEVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK |
| SEQ ID NO: 251 | XENP010590 | IgG-pI-CH1-v25 | AETKGPSVFPLAPSSESTSGGTAALGCLVKDYFPEPVTVSWNSGALESGVHTFPAVLQSSGLYSLSSVVTVPSSSLGTQTYICNVNHKPSDTEVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK |
| SEQ ID NO: 252 | XENP010591 | IgG-pI-CH1-v42 | ASTKGPSVFPLAPSSKSTSGGTAALGCLVKDYFPEPVTVSWNSGALTSGVHTFPAVLQSSGLYSLSSVVTVPSSSLGTQTYICNVNHKPSDTEVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK |
| SEQ ID NO: 253 | XENP010592 | IgG-pI-CH1-v16 | ASTKGPSVFPLAPSSKSTSGGTAALGCLVKDYFPEPVTVSWNSGALTSGVHTFPAVLQSSGLYSLSSVVTVPSSSLGTQTYICNVNHKPSDTEVDKKVEPKSCDKTHTCPPCPAPELLGGPSVFLFPPKPKDTLMISRTPEVTCVVVDVSHEDPEVQFNWYVDGVEVHNAKTKPREEQYNSTYRVVSVLTVVHQDWLNGKEYKCKVSNKALPAPIEKTISKTKGQPREPQVYTLPPSQEEMTKNQVSLTCLVKGFYPSDIAVEWESSGQPENNYNTTPPMLDSDGSFFLYSKLTVDKSRWQEGNVFSCSVMHEALHSHYTQKSLSLSPG |
| SEQ ID NO: 254 | XENP010593 | IgG-pI-CH1-v4-SLFFV-Iso-434S | AETKGPSVFPLAPSSESTSGGTAALGCLVKDYFPEPVTVSWNSGALESGVHTFPAVLQSSGLYSLSSVVTVPSSSLGTQTYICNVNHKPSDTEVDKKVEPKSCDKTHTCPPCPAPELLGGPSVFLFPPKPKDTLMISRTPEVTCVVVDVSHEDPEVQFNWYVDGVEVHNAKTKPREEQFNSTFRVVSVLTVVHQDWLNGKEYKCKVSNKALPAPIEKTISKTKGQPREPQVYTLPPSQEEMTKNQVSLTCLVKGFYPSDIAVEWESSGQPENNYNTTPPMLDSDGSFFLYSKLTVDKSRWQEGNVFSCSVMHEALHSHYTQKSLSLSPG |
| SEQ ID NO: 255 | XENP010594 | IgG-pI-CH1-v25-SLFFV-Iso-434S | AETKGPSVFPLAPSSESTSGGTAALGCLVKDYFPEPVTVSWNSGALESGVHTFPAVLQSSGLYSLSSVVTVPSSSLGTQTYICNVNHKPSDTEVDKKVEPKSCDKTHTCPPCPAPELLGGPSVFLFPPKPKDTLMISRTPEVTCVVVDVSHEDPEVQFNWYVDGVEVHNAKTKPREEQFNSTFRVVSVLTVVHQDWLNGKEYKCKVSNKALPAPIEKTISKTKGQPREPQVYTLPPSQEEMTKNQVSLTCLVKGFYPSDIAVEWESSGQPENNYNTTPPMLDSDGSFFLYSKLTVDKSRWQEGNVFSCSVMHEALHSHYTQKSLSLSPG |

Figure 92 (cont.)

| | XenP | Patent name (HC) | Sequence |
|---|---|---|---|
| SEQ ID NO: 256 | XENP010595 | IgG-pI-CH1-v42-SLFFV-Iso-434S | ASTKGPSVFPLAPSSKSTSGGTAALGCLVKDYFPEPVTVSWNSGALESGVHTFPAVLQSSGLYSLSSVVTVPSSSLGTQTYICNVNHKPSDTEVDKKVEPKSCDKTHTCPPCPAPELLGGPSVFLFPPKPKDTLMISRTPEVTCVVVDVSHEDPEVQFNWYVDGVEHNAKTKPREEQFNSTFRVVSVLTVVHQDWLNGKEYKCKVSNKALPAPIEKTISKTKGQPREPQVYTLPPSQEEMTKNQVSLTCLVKGFYPSDIAVEWESSGQPENNYNTTPPMLDSDGSFFLYSKLTVDKSRWQEGNVFSCSVMHEALHSHYTQKSLSLSPG |
| SEQ ID NO: 257 | XENP010596 | IgG-pI-CH1-v16-SLFFV-Iso-434S | ASTKGPSVFPLAPSSKSTSGGTAALGCLVKDYFPEPVTVSWNSGALTSGVHTFPAVLQSSGLYSLSSVVTVPSSSLGTQTYICNVNHKPSDTEVDKKVEPKSCDKTHTCPPCPAPELLGGPSVFLFPPKPKDTLMISRTPEVTCVVVDVSHEDPEVQFNWYVDGVEVHNAKTKPREEQFNSTFRVVSVLTVVHQDWLNGKEYKCKVSNKALPAPIEKTISKTKGQPREPQVYTLPPSQEEMTKNQVSLTCLVKGFYPSDIAVEWESSGQPENNYNTTPPMLDSDGSFFLYSKLTVDKSRWQEGNVFSCSVMHEALHSHYTQKSLSLSPG |
| SEQ ID NO: 258 | XENP010601 | IgG-pI-CH1-v4-SL-Iso-434S | AETKGPSVFPLAPSSESTSGGTAALGCLVKDYFPEPVTVSWNSGALESGVHTFPAVLQSSGLYSLSSVVTVPSSSLGTQTYICNVNHKPSDTEVDKKVEPKSCDKTHTCPPCPAPELLGGPSVFLFPPKPKDTLMISRTPEVTCVVVDVSHEDPEVQFNWYVDGVEVHNAKTKPREEQYNSTYRVVSVLTVLHQDWLNGKEYKCKVSNKALPAPIEKTISKTKGQPREPQVYTLPPSQEEMTKNQVSLTCLVKGFYPSDIAVEWESSGQPENNYNTTPPMLDSDGSFFLYSKLTVDKSRWQEGNVFSCSVMHEALHSHYTQKSLSLSPG |
| SEQ ID NO: 259 | XENP010602 | IgG-pI-CH1-v25-SL-Iso-434S | AETKGPSVFPLAPSSKSTSGGTAALGCLVKDYFPEPVTVSWNSGALESGVHTFPAVLQSSGLYSLSSVVTVPSSSLGTQTYICNVNHKPSDTEVDKKVEPKSCDKTHTCPPCPAPELLGGPSVFLFPPKPKDTLMISRTPEVTCVVVDVSHEDPEVQFNWYVDGVEVHNAKTKPREEQYNSTYRVVSVLTVLHQDWLNGKEYKCKVSNKALPAPIEKTISKTKGQPREPQVYTLPPSQEEMTKNQVSLTCLVKGFYPSDIAVEWESSGQPENNYNTTPPMLDSDGSFFLYSKLTVDKSRWQEGNVFSCSVMHEALHSHYTQKSLSLSPG |
| SEQ ID NO: 260 | XENP010603 | IgG-pI-CH1-v42-SL-Iso-434S | ASTKGPSVFPLAPSSKSTSGGTAALGCLVKDYFPEPVTVSWNSGALESGVHTFPAVLQSSGLYSLSSVVTVPSSSLGTQTYICNVNHKPSDTEVDKKVEPKSCDKTHTCPPCPAPELLGGPSVFLFPPKPKDTLMISRTPEVTCVVVDVSHEDPEVQFNWYVDGVEVHNAKTKPREEQYNSTYRVVSVLTVLHQDWLNGKEYKCKVSNKALPAPIEKTISKTKGQPREPQVYTLPPSQEEMTKNQVSLTCLVKGFYPSDIAVEWESSGQPENNYNTTPPMLDSDGSFFLYSKLTVDKSRWQEGNVFSCSVMHEALHSHYTQKSLSLSPG |
| SEQ ID NO: 261 | XENP010604 | IgG-pI-CH1-v16-SL-Iso-434S | ASTKGPSVFPLAPSSKSTSGGTAALGCLVKDYFPEPVTVSWNSGALTSGVHTFPAVLQSSGLYSLSSVVTVPSSSLGTQTYICNVNHKPSDTEVDKKVEPKSCDKTHTCPPCPAPELLGGPSVFLFPPKPKDTLMISRTPEVTCVVVDVSHEDPEVQFNWYVDGVEVHNAKTKPREEQYNSTYRVVSVLTVLHQDWLNGKEYKCKVSNKALPAPIEKTISKTKGQPREPQVYTLPPSQEEMTKNQVSLTCLVKGFYPSDIAVEWESSGQPENNYNTTPPMLDSDGSFFLYSKLTVDKSRWQEGNVFSCSVMHEALHSHYTQKSLSLSPG |

Figure 92 (cont.)

| | XenP | Patent name (HC) | Sequence |
|---|---|---|---|
| SEQ ID NO: 262 | XENP010621 | IgG1-pI-IF16-ISO | ASTKGPSVFPLAPSSKSTSGGTAALGCLVKDYFPEPVTVSWNSGALESGVHTFPAVLQ SSGLYSLSSVVTVPSSSLGTQTYICNVNHKPSDTEVDKKVEPKSCDKTHTCPPCPAPEL LGGPSVFLFPPKPKDTLMISRTPEVTCVVVDVSHEDPEVQFNWYVDGVEVHNAKTKPR EEQYNSTYRVVSVLTVLHQDWLNGKEYKCKVSNKALPAPIEKTISKAKGQPREPQVYTL PPSQEEMTKNQVSLTCLVKGFYPSDIAVEWESSGQPENNYNTTPPMLDSDGSFFLYSK LTVDKSRWQEGNVFSCSVMHEALHNHYTQKSLSLSPG |
| SEQ ID NO: 263 | XENP010622 | IgG1-pI-IF10-ISO | ASTKGPSVFPLAPSSKSTSGGTAALGCLVKDYFPEPVTVSWNSGALTSGVHTFPAVLQ SSGLYSLSSVVTVPSSSLGTQTYICNVNHKPSDTEVDKKVEPKSCDKTHTCPPCPAPEL LGGPSVFLFPPKPKDTLMISRTPEVTCVVVDVSHEDPEVQFNWYVDGVEVHNAKTKPR EEQYNSTYRVVSVLTVLHQDWLNGKEYKCKVSNKALPAPIEKTISKAKGQPREPQVYTL PPSQEEMTKNQVSLTCLVKGFYPSDIAVEWESSGQPENNYNTTPPMLDSDGSFFLYSK LTVDKSRWQEGNVFSCSVMHEALHNHYTQKSLSLSPG |
| SEQ ID NO: 264 | XENP010623 | IgG2-pI-IF10-ISO-N434S | ASTKGPSVFPLAPCSRSTSESTAALGCLVKDYFPEPVTVSWNSGALTSGVHTFPAVLQS SGLYSLSSVVTVPSSNFGTQTYTCNVDHEPSDTKVDKTVERKCCVECPPCAPPVAGP SVFLFPPKPKDTLMISRTPEVTCVVVDVSHEDPEVQFNWYVDGVEVHNAKTKPREEQF NSTFRVVSVLTVVHQDWLNGKEYKCKVSNKGLPAPIEKTISKTKGQPREPQVYTLPPSQ EEMTKNQVSLTCLVKGFYPSDIAVEWESSGQPENNYNTTPPMLDSDGSFFLYSKLTVD KSRWQEGNVFSCSVMHEALHSHYTQKSLSLSPG |
| SEQ ID NO: 265 | XENP010624 | IgG2-pI-IF16-ISO-N434S | ASTKGPSVFPLAPCSRSTSESTAALGCLVKDYFPEPVTVSWNSGALESGVHTFPAVLQS SGLYSLSSVVTVPSSNFGTQTYTCNVDHEPSDTKVDKTVERKCCVECPPCAPPVAGP SVFLFPPKPKDTLMISRTPEVTCVVVDVSHEDPEVQFNWYVDGVEVHNAKTKPREEQF NSTFRVVSVLTVVHQDWLNGKEYKCKVSNKGLPAPIEKTISKTKGQPREPQVYTLPPSQ EEMTKNQVSLTCLVKGFYPSDIAVEWESSGQPENNYNTTPPMLDSDGSFFLYSKLTVD KSRWQEGNVFSCSVMHEALHSHYTQKSLSLSPG |
| SEQ ID NO: 266 | XENP010625 | Hybrid-pI-IF16-ISO-N434S | ASTKGPSVFPLAPSSKSTSGGTAALGCLVKDYFPEPVTVSWNSGALESGVHTFPAVLQ SSGLYSLSSVVTVPSSSLGTQTYICNVNHKPSDTEVDKKVEPKSCDKTHTCPPCPAPEL LGGPSVFLFPPKPKDTLMISRTPEVTCVVVDVSHEDPEVQFNWYVDGVEVHNAKTKPR EEQFNSTFRVVSVLTVVHQDWLNGKEYKCKVSNKALPAPIEKTISKTKGQPREPQVYTL PPSQEEMTKNQVSLTCLVKGFYPSDIAVEWESSGQPENNYNTTPPMLDSDGSFFLYSK LTVDKSRWQEGNVFSCSVMHEALHSHYTQKSLSLSPG |
| SEQ ID NO: 267 | XENP010626 | Hybrid-pI-IF16-ISO-N434S | ASTKGPSVFPLAPSSKSTSGGTAALGCLVKDYFPEPVTVSWNSGALTSGVHTFPAVLQ SSGLYSLSSVVTVPSSSLGTQTYICNVNHKPSDTEVDKKVEPKSCDKTHTCPPCPAPEL LGGPSVFLFPPKPKDTLMISRTPEVTCVVVDVSHEDPEVQFNWYVDGVEVHNAKTKPR EEQFNSTFRVVSVLTVVHQDWLNGKEYKCKVSNKALPAPIEKTISKTKGQPREPQVYTL PPSQEEMTKNQVSLTCLVKGFYPSDIAVEWESSGQPENNYNTTPPMLDSDGSFFLYSK LTVDKSRWQEGNVFSCSVMHEALHSHYTQKSLSLSPG |

Figure 92 (cont.)

| SEQ ID NO: | XenP | Patent name (HC) | Sequence |
|---|---|---|---|
| SEQ ID NO: 268 | XENP010628 | Hybrid-2-1-2-pI-iF16-ISO-N434S | ASTKGPSVFPLAPSSRSTSESTAALGCLVKDYFPEPVTVSWNSGALESGVHTFPAVLQS SGLYSLSSVVTVPSSNFGTQTYTCNVDHEPSDTEVDKTVEPKSCDKTHTCPPCPAPELL GGPSVFLFPPKPKDTLMISRTPEVTCVVVDVSHEDPEVQFNWYVDGVEVHNAKTKPRE EQFNSTFRVVSVLTVVHQDWLNGKEYKCKVSNKALPAPIEKTISKTKGQPREPQVYTLP PSQEEMTKNQVSLTCLVKGFYPSDIAVEWESSGQPENNYNTTPPMLDSDGSFFLYSKL TVDKSRWQEGNVFSCSVMHEALHSHYTQKSLSLSPG |
| SEQ ID NO: 269 | XENP010629 | Hybrid-2-1-2-pI-iF10-ISO-N434S | ASTKGPSVFPLAPSSRSTSESTAALGCLVKDYFPEPVTVSWNSGALTSGVHTFPAVLQS SGLYSLSSVVTVPSSNFGTQTYTCNVDHEPSDTEVDKTVEPKSCDKTHTCPPCPAPELL GGPSVFLFPPKPKDTLMISRTPEVTCVVVDVSHEDPEVQFNWYVDGVEVHNAKTKPRE EQFNSTFRVVSVLTVVHQDWLNGKEYKCKVSNKALPAPIEKTISKTKGQPREPQVYTLP PSQEEMTKNQVSLTCLVKGFYPSDIAVEWESSGQPENNYNTTPPMLDSDGSFFLYSKL TVDKSRWQEGNVFSCSVMHEALHSHYTQKSLSLSPG |
| SEQ ID NO: 270 | XENP010648 | IgG1-iF10-CH1-Fc-charges | ASTKGPSVFPLAPSSKSTSGGTAALGCLVKDYFPEPVTVSWNSGALESGVHTFPAVLQ SSGLYSLSSVVTVPSSSLGTQTYICNVNHKPSDTEVDKKVEPKSCDKTHTCPPCPAPEL LGGPSVFLFPPKPKDTLMISRTPEVTCVVVDVSHEDPEVKFNWYVDGVEVHNAKTKPR EEQYNSTYRVVSVLTVLHQDWLNGKEYKCKVSNKALPAPIEKTISKAKGQPREPQVYTL PPSEEEMTKNQVSLTCLVKGFYPSDIAVEWESNGQPEENNYKTTPPVLDSDGSFFLYSKL TVDKSRWQQGNVFSCSVMHEALHNHYTQKSLSLEPG |
| SEQ ID NO: 271 | XENP010649 | IgG1-iF16-CH1-Fc-charges | ASTKGPSVFPLAPSSKSTSGGTAALGCLVKDYFPEPVTVSWNSGALTSGVHTFPAVLQ SSGLYSLSSVVTVPSSSLGTQTYICNVNHKPSDTEVDKKVEPKSCDKTHTCPPCPAPEL LGGPSVFLFPPKPKDTLMISRTPEVTCVVVDVSHEDPEVEFNWYVDGVEVHNAKTKPR EEQYNSTYRVVSVLTVLHQDWLNGKEYKCKVSNKALPAPIEKTISKAKGQPREPQVYTL PPSEEEMKNEVSLTCLVKGFYPSDIAVEWESNGQPEENNYKTTPPVLDSDGSFFLYSKL TVDKSRWQQGNVFSCSVMHEALHNHYTQKSLSLEPG |
| SEQ ID NO: 272 | XENP010650 | IgG1-iF10-ISO-CH1-Fc-charges | ASTKGPSVFPLAPSSKSTSGGTAALGCLVKDYFPEPVTVSWNSGALTSGVHTFPAVLQ SSGLYSLSSVVTVPSSSLGTQTYICNVNHKPSDTEVDKKVEPKSCDKTHTCPPCPAPEL LGGPSVFLFPPKPKDTLMISRTPEVTCVVVDVSHEDPEVQFNWYVDGVEVHNAKTKPR EEQYNSTYRVVSVLTVLHQDWLNGKEYKCKVSNKALPAPIEKTISKAKGQPREPQVYTL PPSEEEMTKNQVSLTCLVKGFYPSDIAVEWESSGQPENNYNTTPPMLDSDGSFFLYSK LTVDKSRWQQGNVFSCSVMHEALHNHYTQKSLSLEPG |
| SEQ ID NO: 273 | XENP010651 | IgG1-iF16-ISO-CH1-Fc-charges | ASTKGPSVFPLAPSSKSTSGGTAALGCLVKDYFPEPVTVSWNSGALESGVHTFPAVLQ SSGLYSLSSVVTVPSSSLGTQTYICNVNHKPSDTEVDKKVEPKSCDKTHTCPPCPAPEL LGGPSVFLFPPKPKDTLMISRTPEVTCVVVDVSHEDPEVEFNWYVDGVEVHNAKTKPR EEQYNSTYRVVSVLTVLHQDWLNGKEYKCKVSNKALPAPIEKTISKAKGQPREPQVYTL PPSEEEMKNEVSLTCLVKGFYPSDIAVEWESSGQPENNYNTTPPMLDSDGSFFLYSK LTVDKSRWEEGNVFSCSVMHEALHNHYTQKSLSLEPG |

Figure 92 (cont.)

| | XenP | Patent name (HC) | Sequence |
|---|---|---|---|
| SEQ ID NO: 274 | XENP010780 | IgG1-pI-ISO(-) | ASTKGPSVFPLAPSSKSTSGGTAALGCLVKDYFPEPVTVSWNSGALTSGVHTFPAVLQ SSGLYSLSSVVTVPSSSLGTQTYTCNVDHKPSNTKVDKKVEPKSCDKTHTCPPCPAPEL LGGPSVFLFPPKPKDTLMISRTPEVTCVVVDVSHEDPEVQFNWYVDGVEVHNAKTKPR EEQYNSTYRVVSVLTVLHQDWLNGKEYKCKVSNKALPAPIEKTISKAKGQPREPQVYTL PPSQEEMTKNQVSLTCLVKGFYPSDIAVEWESSGQPENNYNTTPPMLDSDGSFFLYSK LTVDKSRWQEGNVFSCSVMHEALHNHYTQKSLSLSPG |
| SEQ ID NO: 275 | XENP010781 | IgG1-pI-ISO(+RR) | ASTKGPSVFPLAPSSKSTSGGTAALGCLVKDYFPEPVTVSWNSGALTSGVHTFPAVLQ SSGLYSLSSVVTVPSSSLGTKTYTCNVNHKPSNTKVDKVERKSCDKTHTCPRCPAPEL LGGPSVFLFPPKPKDTLMISRTPEVTCVVVDVSHEDPEVKFKWYVDGVEVHNAKTKPR EEQYNSTYRVVSVLTVLHQDWLNGKEYKCKVSNKALPAPIEKTISKAKGQPREPQVYTL PPSREEMTKNQVSLTCLVKGFYPSDIAVEWESNGQPENNYKTTPPVLDSDGSFFLYSKL TVDKSRWQQGNVFSCSVMHEALHNHYTQKSLSLSPGK |
| SEQ ID NO: 276 | XENP010782 | IgG1-pI-ISO(+) | ASTKGPSVFPLAPSSKSTSGGTAALGCLVKDYFPEPVTVSWNSGALTSGVHTFPAVLQ SSGLYSLSSVVTVPSSSLGTKTYTCNVNHKPSNTKVDKKVEPKSCDKTHTCPPCPAPEL LGGPSVFLFPPKPKDTLMISRTPEVTCVVVDVSHEDPEVKFKWYVDGVEVHNAKTKPR EEQYNSTYRVVSVLTVLHQDWLNGKEYKCKVSNKALPAPIEKTISKAKGQPREPQVYTL PPSREEMTKNQVSLTCLVKGFYPSDIAVEWESNGQPENNYKTTPPVLDSDGSFFLYSKL TVDKSRWQQGNVFSCSVMHEALHNHYTQKSLSLSPGK |

Figure 93

| SEQ ID NO: | XenP# | Patent name (LC) | Sequence |
|---|---|---|---|
| 277 | XENP004547 | Ck-WT | RTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC |
| 278 | XENP006384 | Ck-WT | RTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC |
|  | NA | Ck-WT |  |
|  | NA | Ck-WT |  |
| 279 | XENP007349 | Ck-WT | RTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC |
| 280 | XENP005653 | Ck-WT | RTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC |
| 281 | XENP006389 | Ck-WT | RTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC |
| 282 | XENP009491 | Ck-WT | RTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC |
| 283 | XENP009492 | Ck-pI(6) | RTVAAPSVFIFPPSDEQLESGTASVVCLLNNFYPREAEVQWKVDDALQEGNSQESVTEQDSEDSTYSLSSTLTLSKADYEKHKVYACEVTHQGLESPVTKSFNRGEC |
| 284 | XENP009493 | Ck-pI(6) | RTVAAPSVFIFPPSDEQLESGTASVVCLLNNFYPREAEVQWKVDDALQEGNSQESVTEQDSEDSTYSLSSTLTLSKADYEKHKVYACEVTHQGLESPVTKSFNRGEC |
| 285 | XENP009992 | Ck-pI(6) | RTVAAPSVFIFPPSDEQLESGTASVVCLLNNFYPREAEVQWKVDDALQEGNSQESVTEQDSEDSTYSLSSTLTLSKADYEKHKVYACEVTHQGLESPVTKSFNRGEC |
| 286 | XENP009993 | Ck-pI(6) | RTVAAPSVFIFPPSDEQLESGTASVVCLLNNFYPREAEVQWKVDDALQEGNSQESVTEQDSEDSTYSLSSTLTLSKADYEKHKVYACEVTHQGLESPVTKSFNRGEC |
| 287 | XENP010088 | Ck-pI(3) | RTVAAPSVFIFPPSDEQLESGTASVVCLLNNFYPREAEVQWKVDNALQSGNSQESVTEQDSEDSTYSLSSTLTLSKADYEKHKVYACEVTHQGLESPVTKSFNRGEC |
| 288 | XENP010089 | Ck-pI(6-DEDE) | RTVAAPSVFIFPPSDEQLESGTASVVCLLNNFYPREAEVQWKVDDALQEGNSQESVTEQDSEDSTYSLSSTLTLSKADYEKHKVYACEVTHQGLESPVTKSFNRGECDEDE |
| 289 | XENP010090 | Ck-pI(3) | RTVAAPSVFIFPPSDEQLESGTASVVCLLNNFYPREAEVQWKVDNALQSGNSQESVTEQDSEDSTYSLSSTLTLSKADYEKHKVYACEVTHQGLESPVTKSFNRGEC |

Figure 93 (cont.)

| 290 | XENP010091 | Ck-pI(6) | RTVAAPSVFIFPPSDEQLESGTASVVCLLNNFYPREAEVQWKVDDALQEGNSQESVTEQDSEDSTYSLSSTLTLSKADYEKHKVYACEVTHQGLESPVTKSFNRGEC |
| --- | --- | --- | --- |
| 291 | XENP010092 | Ck-pI(6-DEDE) | RTVAAPSVFIFPPSDEQLESGTASVVCLLNNFYPREAEVQWKVDDALQEGNSQESVTEQDSEDSTYSLSSTLTLSKADYEKHKVYACEVTHQGLESPVTKSFNRGECDEDE |
| 292 | XENP010093 | Ck-WT | RTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC |
| 293 | XENP010094 | Ck-WT | RTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC |
| 294 | XENP010095 | Ck-WT | RTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC |
| 295 | XENP010096 | Ck-pI(3) | RTVAAPSVFIFPPSDEQLESGTASVVCLLNNFYPREAEVQWKVDNALQSGNSQESVTEQDSEDSTYSLSSTLTLSKADYEKHKVYACEVTHQGLSSPVTKSFNRGEC |
| 296 | XENP010101 | Ck-pI(6) | RTVAAPSVFIFPPSDEQLESGTASVVCLLNNFYPREAEVQWKVDDALQEGNSQESVTEQDSEDSTYSLSSTLTLSKADYEKHKVYACEVTHQGLESPVTKSFNRGEC |
| 297 | XENP010102 | Ck-pI(6-DEDE) | RTVAAPSVFIFPPSDEQLESGTASVVCLLNNFYPREAEVQWKVDDALQEGNSQESVTEQDSEDSTYSLSSTLTLSKADYEKHKVYACEVTHQGLESPVTKSFNRGECDEDE |
| 298 | XENP010103 | Ck-WT | RTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC |
| 299 | XENP010104 | Ck-pI(3) | RTVAAPSVFIFPPSDEQLESGTASVVCLLNNFYPREAEVQWKVDNALQSGNSQESVTEQDSEDSTYSLSSTLTLSKADYEKHKVYACEVTHQGLSSPVTKSFNRGEC |
| 300 | XENP010105 | Ck-pI(6) | RTVAAPSVFIFPPSDEQLESGTASVVCLLNNFYPREAEVQWKVDDALQEGNSQESVTEQDSEDSTYSLSSTLTLSKADYEKHKVYACEVTHQGLESPVTKSFNRGEC |
| 301 | XENP010106 | Ck-pI(6-DEDE) | RTVAAPSVFIFPPSDEQLESGTASVVCLLNNFYPREAEVQWKVDDALQEGNSQESVTEQDSEDSTYSLSSTLTLSKADYEKHKVYACEVTHQGLESPVTKSFNRGECDEDE |
| 302 | XENP010107 | Ck-pI(4) | RTVAAPSVFIFPPSDEQLESGTASVVCLLNNFYPREAEVQWKVDNALQSGNSQESVTEQDSEDSTYSLSSTLTLSKADYEKHKVYACEVTHQGLSSPVTESFNRGEC |
| 303 | XENP010108 | Ck-pI(4) | RTVAAPSVFIFPPSDEQLESGTASVVCLLNNFYPREAEVQWKVDNALQSGNSQESVTEQDSEDSTYSLSSTLTLSKADYEKHKVYACEVTHQGLSSPVTESFNRGEC |
| 304 | XENP010109 | Ck-pI(4) | RTVAAPSVFIFPPSDEQLESGTASVVCLLNNFYPREAEVQWKVDNALQSGNSQESVTEQDSEDSTYSLSSTLTLSKADYEKHKVYACEVTHQGLSSPVTESFNRGEC |
| 305 | XENP010110 | Ck-pI(4) | RTVAAPSVFIFPPSDEQLESGTASVVCLLNNFYPREAEVQWK |

Figure 93 (cont.)

| | | | |
|---|---|---|---|
| | | | VDNALQSGNSQESVTEQDSEDSTYSLSSTLTLSKADYEKHKV YACEVTHQGLSSPVTESFNRGEC |
| 306 | XENP010017 | CK-N152D S156E S202E | RTVAAPSVFIFPPSDEQLKSGTASVVCLLNNFYPREAKVQWK VDDALQEGNSQESVTEQDSKDSTYSLSSTLTLSKADYEKHKV YACEVTHQGLESPVTKSFNRGEC |
| 307 | XENP010018 | CK-K126Q K145Q K169Q | RTVAAPSVFIFPPSDEQLQSGTASVVCLLNNFYPREAQVQW KVDNALQSGNSQESVTEQDSQDSTYSLSSTLTLSKADYEKHK VYACEVTHQGLSSPVTKSFNRGEC |
| 308 | XENP010019 | CK-K126E K145E K169E | RTVAAPSVFIFPPSDEQLESGTASVVCLLNNFYPREAEVQWK VDNALQSGNSQESVTEQDSEDSTYSLSSTLTLSKADYEKHKV YACEVTHQGLSSPVTKSFNRGEC |
| 309 | XENP010178 | Ck-WT | RTVAAPSVFIFPPSDEQLKSGTASVVCLLNNFYPREAKVQWK VDNALQSGNSQESVTEQDSKDSTYSLSSTLTLSKADYEKHKV YACEVTHQGLSSPVTKSFNRGEC |
| 310 | XENP010179 | Ck-WT | RTVAAPSVFIFPPSDEQLKSGTASVVCLLNNFYPREAKVQWK VDNALQSGNSQESVTEQDSKDSTYSLSSTLTLSKADYEKHKV YACEVTHQGLSSPVTKSFNRGEC |
| 311 | XENP010180 | Ck-WT | RTVAAPSVFIFPPSDEQLKSGTASVVCLLNNFYPREAKVQWK VDNALQSGNSQESVTEQDSKDSTYSLSSTLTLSKADYEKHKV YACEVTHQGLSSPVTKSFNRGEC |
| 312 | XENP010181 | Ck-WT | RTVAAPSVFIFPPSDEQLKSGTASVVCLLNNFYPREAKVQWK VDNALQSGNSQESVTEQDSKDSTYSLSSTLTLSKADYEKHKV YACEVTHQGLSSPVTKSFNRGEC |
| 313 | XENP010182 | Ck-pI(4) | RTVAAPSVFIFPPSDEQLESGTASVVCLLNNFYPREAEVQWK VDNALQSGNSQESVTEQDSEDSTYSLSSTLTLSKADYEKHKV YACEVTHQGLSSPVTESFNRGEC |
| 314 | XENP010183 | Ck-pI(4) | RTVAAPSVFIFPPSDEQLESGTASVVCLLNNFYPREAEVQWK VDNALQSGNSQESVTEQDSEDSTYSLSSTLTLSKADYEKHKV YACEVTHQGLSSPVTESFNRGEC |
| 315 | XENP010184 | Ck-pI(4) | RTVAAPSVFIFPPSDEQLESGTASVVCLLNNFYPREAEVQWK VDNALQSGNSQESVTEQDSEDSTYSLSSTLTLSKADYEKHKV YACEVTHQGLSSPVTESFNRGEC |
| 316 | XENP010185 | Ck-pI(4) | RTVAAPSVFIFPPSDEQLESGTASVVCLLNNFYPREAEVQWK VDNALQSGNSQESVTEQDSEDSTYSLSSTLTLSKADYEKHKV YACEVTHQGLSSPVTESFNRGEC |
| 317 | XENP010265 | | RTVAAPSVFIFPPSDEQLKSGTASVVCLLNNFYPREAKVQWK VDNALQSGNSQESVTEQDSKDSTYSLSSTLTLSKADYEKHKV YACEVTHQGLSSPVTKSFNRGEC |
| 318 | XENP010266 | | RTVAAPSVFIFPPSDEQLKSGTASVVCLLNNFYPREAKVQWK VDNALQSGNSQESVTEQDSKDSTYSLSSTLTLSKADYEKHKV YACEVTHQGLSSPVTKSFNRGEC |
| 319 | XENP010267 | | RTVAAPSVFIFPPSDEQLKSGTASVVCLLNNFYPREAKVQWK VDNALQSGNSQESVTEQDSKDSTYSLSSTLTLSKADYEKHKV YACEVTHQGLSSPVTKSFNRGEC |
| 320 | XENP010268 | | RTVAAPSVFIFPPSDEQLKSGTASVVCLLNNFYPREAKVQWK VDNALQSGNSQESVTEQDSKDSTYSLSSTLTLSKADYEKHKV |

Figure 93 (cont.)

| | | | |
|---|---|---|---|
| | | | YACEVTHQGLSSPVTKSFNRGEC |
| 321 | XENP010269 | | RTVAAPSVFIFPPSDEQLKSGTASVVCLLNNFYPREAKVQWK VDNALQSGNSQESVTEQDSKDSTYSLSSTLTLSKADYEKHKV YACEVTHQGLSSPVTKSFNRGEC |
| 322 | XENP010270 | | RTVAAPSVFIFPPSDEQLKSGTASVVCLLNNFYPREAKVQWK VDNALQSGNSQESVTEQDSKDSTYSLSSTLTLSKADYEKHKV YACEVTHQGLSSPVTKSFNRGEC |
| 323 | XENP010271 | | RTVAAPSVFIFPPSDEQLKSGTASVVCLLNNFYPREAKVQWK VDNALQSGNSQESVTEQDSKDSTYSLSSTLTLSKADYEKHKV YACEVTHQGLSSPVTKSFNRGEC |
| 324 | XENP010272 | | RTVAAPSVFIFPPSDEQLKSGTASVVCLLNNFYPREAKVQWK VDNALQSGNSQESVTEQDSKDSTYSLSSTLTLSKADYEKHKV YACEVTHQGLSSPVTKSFNRGEC |
| 325 | XENP010273 | | RTVAAPSVFIFPPSDEQLKSGTASVVCLLNNFYPREAKVQWK VDNALQSGNSQESVTEQDSKDSTYSLSSTLTLSKADYEKHKV YACEVTHQGLSSPVTKSFNRGEC |
| 326 | XENP010274 | | RTVAAPSVFIFPPSDEQLKSGTASVVCLLNNFYPREAKVQWK VDNALQSGNSQESVTEQDSKDSTYSLSSTLTLSKADYEKHKV YACEVTHQGLSSPVTKSFNRGEC |
| 327 | XENP010275 | | RTVAAPSVFIFPPSDEQLKSGTASVVCLLNNFYPREAKVQWK VDNALQSGNSQESVTEQDSKDSTYSLSSTLTLSKADYEKHKV YACEVTHQGLSSPVTKSFNRGEC |
| 328 | XENP010276 | | RTVAAPSVFIFPPSDEQLKSGTASVVCLLNNFYPREAKVQWK VDNALQSGNSQESVTEQDSKDSTYSLSSTLTLSKADYEKHKV YACEVTHQGLSSPVTKSFNRGEC |
| 329 | XENP010277 | | RTVAAPSVFIFPPSDEQLKSGTASVVCLLNNFYPREAKVQWK VDNALQSGNSQESVTEQDSKDSTYSLSSTLTLSKADYEKHKV YACEVTHQGLSSPVTKSFNRGEC |
| 330 | XENP010278 | | RTVAAPSVFIFPPSDEQLKSGTASVVCLLNNFYPREAKVQWK VDNALQSGNSQESVTEQDSKDSTYSLSSTLTLSKADYEKHKV YACEVTHQGLSSPVTKSFNRGEC |
| 331 | XENP010279 | | RTVAAPSVFIFPPSDEQLKSGTASVVCLLNNFYPREAKVQWK VDNALQSGNSQESVTEQDSKDSTYSLSSTLTLSKADYEKHKV YACEVTHQGLSSPVTKSFNRGEC |
| 332 | XENP010280 | | RTVAAPSVFIFPPSDEQLKSGTASVVCLLNNFYPREAKVQWK VDNALQSGNSQESVTEQDSKDSTYSLSSTLTLSKADYEKHKV YACEVTHQGLSSPVTKSFNRGEC |
| 333 | XENP010281 | | RTVAAPSVFIFPPSDEQLKSGTASVVCLLNNFYPREAKVQWK VDNALQSGNSQESVTEQDSKDSTYSLSSTLTLSKADYEKHKV YACEVTHQGLSSPVTKSFNRGEC |
| 334 | XENP010282 | | RTVAAPSVFIFPPSDEQLKSGTASVVCLLNNFYPREAKVQWK VDNALQSGNSQESVTEQDSKDSTYSLSSTLTLSKADYEKHKV YACEVTHQGLSSPVTKSFNRGEC |
| 335 | XENP010283 | | RTVAAPSVFIFPPSDEQLKSGTASVVCLLNNFYPREAKVQWK VDNALQSGNSQESVTEQDSKDSTYSLSSTLTLSKADYEKHKV YACEVTHQGLSSPVTKSFNRGEC |

Figure 93 (cont.)

| | | | |
|---|---|---|---|
| 336 | XENP010284 | | RTVAAPSVFIFPPSDEQLKSGTASVVCLLNNFYPREAKVQWK VDNALQSGNSQESVTEQDSKDSTYSLSSTLTLSKADYEKHKV YACEVTHQGLSSPVTKSFNRGEC |
| 337 | XENP010285 | | RTVAAPSVFIFPPSDEQLKSGTASVVCLLNNFYPREAKVQWK VDNALQSGNSQESVTEQDSKDSTYSLSSTLTLSKADYEKHKV YACEVTHQGLSSPVTKSFNRGEC |
| 338 | XENP010286 | Ck-WT | RTVAAPSVFIFPPSDEQLKSGTASVVCLLNNFYPREAKVQWK VDNALQSGNSQESVTEQDSKDSTYSLSSTLTLSKADYEKHKV YACEVTHQGLSSPVTKSFNRGEC |
| 339 | XENP010287 | | RTVAAPSVFIFPPSDEQLKSGTASVVCLLNNFYPREAKVQWK VDNALQSGNSQESVTEQDSKDSTYSLSSTLTLSKADYEKHKV YACEVTHQGLSSPVTKSFNRGEC |
| 340 | XENP010288 | | RTVAAPSVFIFPPSDEQLKSGTASVVCLLNNFYPREAKVQWK VDNALQSGNSQESVTEQDSKDSTYSLSSTLTLSKADYEKHKV YACEVTHQGLSSPVTKSFNRGEC |
| 341 | XENP010289 | | RTVAAPSVFIFPPSDEQLKSGTASVVCLLNNFYPREAKVQWK VDNALQSGNSQESVTEQDSKDSTYSLSSTLTLSKADYEKHKV YACEVTHQGLSSPVTKSFNRGEC |
| 342 | XENP010290 | | RTVAAPSVFIFPPSDEQLKSGTASVVCLLNNFYPREAKVQWK VDNALQSGNSQESVTEQDSKDSTYSLSSTLTLSKADYEKHKV YACEVTHQGLSSPVTKSFNRGEC |
| 343 | XENP010324 | Ck-Iso(3) | QTVAAPSVFIFPPSDEQLQSGTASVVCLLNNFYPREAKVQW KVDNALQSGNSQESVTEQDSKDSTYSLSSTLTLSKADYEKHK VYACEVTHEGLSSPVTKSFNRGEC |
| 344 | XENP010325 | Ck-Iso(4) | QTVAAPSVFIFPPSDEQLQSGTASVVCLLNNFYPREATVQW KVDNALQSGNSQESVTEQDSKDSTYSLSSTLTLSKADYEKHK VYACEVTHEGLSSPVTKSFNRGEC |
| 345 | XENP010326 | Ck-Iso(5) | QTVAAPSVFIFPPSDEELQSGTASVVCLLNNFYPREATVQWK VDNALQSGNSQESVTEQDSKDSTYSLSSTLTLSKADYEKHKV YACEVTHEGLSSPVTKSFNRGEC |
| 346 | XENP010327 | Ck-Iso(6) | QTVAAPSVFIFPPSDEELQSGTASVVCLLNDFYPREATVQWK VDNALQSGNSQESVTEQDSKDSTYSLSSTLTLSKADYEKHKV YACEVTHEGLSSPVTKSFNRGEC |
| 347 | XENP010425 | | RTVAAPSVFIFPPSDEQLKSGTASVVCLLNNFYPREAKVQWK VDNALQSGNSQESVTEQDSKDSTYSLSSTLTLSKADYEKHKV YACEVTHQGLSSPVTKSFNRGEC |
| 348 | XENP010426 | Ck-WT | RTVAAPSVFIFPPSDEQLKSGTASVVCLLNNFYPREAKVQWK VDNALQSGNSQESVTEQDSKDSTYSLSSTLTLSKADYEKHKV YACEVTHQGLSSPVTKSFNRGEC |
| 349 | XENP010427 | Ck-WT | RTVAAPSVFIFPPSDEQLKSGTASVVCLLNNFYPREAKVQWK VDNALQSGNSQESVTEQDSKDSTYSLSSTLTLSKADYEKHKV YACEVTHQGLSSPVTKSFNRGEC |
| 350 | XENP010428 | | RTVAAPSVFIFPPSDEQLKSGTASVVCLLNNFYPREAKVQWK VDNALQSGNSQESVTEQDSKDSTYSLSSTLTLSKADYEKHKV YACEVTHQGLSSPVTKSFNRGEC |
| 351 | XENP010466 | Ck-WT | RTVAAPSVFIFPPSDEQLKSGTASVVCLLNNFYPREAKVQWK |

Figure 93 (cont.)

| | | | |
|---|---|---|---|
| | | | VDNALQSGNSQESVTEQDSKDSTYSLSSTLTLSKADYEKHKVYACEVTHQGLSSPVTKSFNRGEC |
| 352 | XENP010467 | Ck-WT | RTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC |
| | XENP010468 | | RTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC |
| 353 | XENP010469 | | RTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC |
| 354 | XENP010470 | Ck-WT | RTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC |
| 355 | XENP010471 | Ck-WT | RTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC |
| 356 | XENP010472 | Ck-WT | RTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC |
| 357 | XENP010473 | Ck-WT | RTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC |
| 358 | XENP010474 | | RTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC |
| 359 | XENP010475 | | RTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC |
| 360 | XENP010476 | Ck-pI(4) | RTVAAPSVFIFPPSDEQLESGTASVVCLLNNFYPREAEVQWKVDNALQSGNSQESVTEQDSEDSTYSLSSTLTLSKADYEKHKVYACEVTHQGLSSPVTESFNRGEC |
| 361 | XENP010477 | Ck-pI(4) | RTVAAPSVFIFPPSDEQLESGTASVVCLLNNFYPREAEVQWKVDNALQSGNSQESVTEQDSEDSTYSLSSTLTLSKADYEKHKVYACEVTHQGLSSPVTESFNRGEC |
| 362 | XENP010478 | | RTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC |
| 363 | XENP010511 | Ck-Iso(3) | QTVAAPSVFIFPPSDEQLQSGTASVVCLLNNFYPREAKVQWKVDNALQSGNSQESVTEQDSKDSTYSLSSTLTLSKADYEKHKVYACEVTHEGLSSPVTKSFNRGEC |
| 364 | XENP010512 | Ck-Iso(4) | QTVAAPSVFIFPPSDEQLQSGTASVVCLLNNFYPREATVQWKVDNALQSGNSQESVTEQDSKDSTYSLSSTLTLSKADYEKHKVYACEVTHEGLSSPVTKSFNRGEC |
| 365 | XENP010513 | Ck-Iso(5) | QTVAAPSVFIFPPSDEELQSGTASVVCLLNNFYPREATVQWKVDNALQSGNSQESVTEQDSKDSTYSLSSTLTLSKADYEKHKV |

Figure 93 (cont.)

| | | | |
|---|---|---|---|
| | | | YACEVTHEGLSSPVTKSFNRGEC |
| 366 | XENP010517 | Ck-Iso(3) | QTVAAPSVFIFPPSDEQLQSGTASVVCLLNNFYPREAKVQWKVDNALQSGNSQESVTEQDSKDSTYSLSSTLTLSKADYEKHKVYACEVTHEGLSSPVTKSFNRGEC |
| 367 | XENP010518 | Ck-Iso(4) | QTVAAPSVFIFPPSDEQLQSGTASVVCLLNNFYPREATVQWKVDNALQSGNSQESVTEQDSKDSTYSLSSTLTLSKADYEKHK368VYACEVTHEGLSSPVTKSFNRGEC |
| 368 | XENP010519 | Ck-Iso(5) | QTVAAPSVFIFPPSDEELQSGTASVVCLLNNFYPREATVQWKVDNALQSGNSQESVTEQDSKDSTYSLSSTLTLSKADYEKHKVYACEVTHEGLSSPVTKSFNRGEC |
| 369 | XENP010520 | Ck-Iso(3) | QTVAAPSVFIFPPSDEQLQSGTASVVCLLNNFYPREAKVQWKVDNALQSGNSQESVTEQDSKDSTYSLSSTLTLSKADYEKHKVYACEVTHEGLSSPVTKSFNRGEC |
| 370 | XENP010521 | Ck-Iso(4) | QTVAAPSVFIFPPSDEQLQSGTASVVCLLNNFYPREATVQWKVDNALQSGNSQESVTEQDSKDSTYSLSSTLTLSKADYEKHKVYACEVTHEGLSSPVTKSFNRGEC |
| 371 | XENP010522 | Ck-Iso(5) | QTVAAPSVFIFPPSDEELQSGTASVVCLLNNFYPREATVQWKVDNALQSGNSQESVTEQDSKDSTYSLSSTLTLSKADYEKHKVYACEVTHEGLSSPVTKSFNRGEC |
| 372 | XENP010525 | Ck-pI(4) | RTVAAPSVFIFPPSDEQLESGTASVVCLLNNFYPREAEVQWKVDNALQSGNSQESVTEQDSEDSTYSLSSTLTLSKADYEKHKVYACEVTHQGLSSPVTESFNRGEC |
| 373 | XENP010526 | Ck-Iso(5) | QTVAAPSVFIFPPSDEELQSGTASVVCLLNNFYPREATVQWKVDNALQSGNSQESVTEQDSKDSTYSLSSTLTLSKADYEKHKVYACEVTHEGLSSPVTKSFNRGEC |
| 374 | XENP010527 | Ck-Iso(5) | QTVAAPSVFIFPPSDEELQSGTASVVCLLNNFYPREATVQWKVDNALQSGNSQESVTEQDSKDSTYSLSSTLTLSKADYEKHKVYACEVTHEGLSSPVTKSFNRGEC |
| 375 | XENP010589 | CK-v8 | RTVAAPSVFIFPPSDEQLESGTASVVCLLNNFYPREAEVQWKVDDALQSGNSQESVTEQDSEDSTYSLSSTLTLSKADYEKHKVYACEVTHQGLESPVTKSFNRGEC |
| 376 | XENP010590 | CK-v28 | RTVAAPSVFIFPPSDEQLESGTASVVCLLNNFYPREAEVQWKVDNALQEGNSQESVTEQDSEDSTYSLSSTLTLSKADYEKHKVYACEVTHQGLESPVTKSFNRGEC |
| 377 | XENP010591 | CK-v23 | RTVAAPSVFIFPPSDEQLESGTASVVCLLNNFYPREAEVQWKVDNALQSGNSQESVTEQDSEDSTYSLSSTLTLSKADYEKHKVYACEVTHQGLESPVTKSFNRGEC |
| 378 | XENP010592 | CK-v12 | RTVAAPSVFIFPPSDEQLKSGTASVVCLLNNFYPREAEVQWKVDNALQSGNSQESVTEQDSEDSTYSLSSTLTLSKADYEKHKVYACEVTHQGLSSPVTKSFNRGEC |
| 379 | XENP010593 | CK-v8 | RTVAAPSVFIFPPSDEQLESGTASVVCLLNNFYPREAEVQWKVDDALQSGNSQESVTEQDSEDSTYSLSSTLTLSKADYEKHKVYACEVTHQGLESPVTKSFNRGEC |
| 380 | XENP010594 | CK-v28 | RTVAAPSVFIFPPSDEQLESGTASVVCLLNNFYPREAEVQWKVDNALQEGNSQESVTEQDSEDSTYSLSSTLTLSKADYEKHKVYACEVTHQGLESPVTKSFNRGEC |

Figure 93 (cont.)

| | | | |
|---|---|---|---|
| 381 | XENP010595 | CK-v23 | RTVAAPSVFIFPPSDEQLESGTASVVCLLNNFYPREAEVQWK VDNALQSGNSQESVTEQDSEDSTYSLSSTLTLSKADYEKHKV YACEVTHQGLESPVTKSFNRGEC |
| 382 | XENP010596 | CK-v12 | RTVAAPSVFIFPPSDEQLKSGTASVVCLLNNFYPREAEVQWK VDNALQSGNSQESVTEQDSEDSTYSLSSTLTLSKADYEKHKV YACEVTHQGLSSPVTKSFNRGEC |
| 383 | XENP010601 | CK-v8 | RTVAAPSVFIFPPSDEQLESGTASVVCLLNNFYPREAEVQWK VDDALQSGNSQESVTEQDSEDSTYSLSSTLTLSKADYEKHKV YACEVTHQGLESPVTKSFNRGEC |
| 384 | XENP010602 | CK-v28 | RTVAAPSVFIFPPSDEQLESGTASVVCLLNNFYPREAEVQWK VDNALQEGNSQESVTEQDSEDSTYSLSSTLTLSKADYEKHKV YACEVTHQGLESPVTKSFNRGEC |
| 385 | XENP010603 | CK-v23 | RTVAAPSVFIFPPSDEQLESGTASVVCLLNNFYPREAEVQWK VDNALQSGNSQESVTEQDSEDSTYSLSSTLTLSKADYEKHKV YACEVTHQGLESPVTKSFNRGEC |
| 386 | XENP010604 | CK-v12 | RTVAAPSVFIFPPSDEQLKSGTASVVCLLNNFYPREAEVQWK VDNALQSGNSQESVTEQDSEDSTYSLSSTLTLSKADYEKHKV YACEVTHQGLSSPVTKSFNRGEC |
| 387 | XENP010621 | CK-v23 | RTVAAPSVFIFPPSDEQLESGTASVVCLLNNFYPREAEVQWK VDNALQSGNSQESVTEQDSEDSTYSLSSTLTLSKADYEKHKV YACEVTHQGLESPVTKSFNRGEC |
| 388 | XENP010622 | CK-v12 | RTVAAPSVFIFPPSDEQLKSGTASVVCLLNNFYPREAEVQWK VDNALQSGNSQESVTEQDSEDSTYSLSSTLTLSKADYEKHKV YACEVTHQGLSSPVTKSFNRGEC |
| 389 | XENP010623 | CK-v12 | RTVAAPSVFIFPPSDEQLKSGTASVVCLLNNFYPREAEVQWK VDNALQSGNSQESVTEQDSEDSTYSLSSTLTLSKADYEKHKV YACEVTHQGLSSPVTKSFNRGEC |
| 390 | XENP010624 | CK-v23 | RTVAAPSVFIFPPSDEQLESGTASVVCLLNNFYPREAEVQWK VDNALQSGNSQESVTEQDSEDSTYSLSSTLTLSKADYEKHKV YACEVTHQGLESPVTKSFNRGEC |
| 391 | XENP010625 | CK-v23 | RTVAAPSVFIFPPSDEQLESGTASVVCLLNNFYPREAEVQWK VDNALQSGNSQESVTEQDSEDSTYSLSSTLTLSKADYEKHKV YACEVTHQGLESPVTKSFNRGEC |
| 392 | XENP010626 | CK-v12 | RTVAAPSVFIFPPSDEQLKSGTASVVCLLNNFYPREAEVQWK VDNALQSGNSQESVTEQDSEDSTYSLSSTLTLSKADYEKHKV YACEVTHQGLSSPVTKSFNRGEC |
| 393 | XENP010628 | CK-v23 | RTVAAPSVFIFPPSDEQLESGTASVVCLLNNFYPREAEVQWK VDNALQSGNSQESVTEQDSEDSTYSLSSTLTLSKADYEKHKV YACEVTHQGLESPVTKSFNRGEC |
| 394 | XENP010629 | CK-v12 | RTVAAPSVFIFPPSDEQLKSGTASVVCLLNNFYPREAEVQWK VDNALQSGNSQESVTEQDSEDSTYSLSSTLTLSKADYEKHKV YACEVTHQGLSSPVTKSFNRGEC |
| 395 | XENP010648 | CK-v12 | RTVAAPSVFIFPPSDEQLKSGTASVVCLLNNFYPREAEVQWK VDNALQSGNSQESVTEQDSEDSTYSLSSTLTLSKADYEKHKV YACEVTHQGLSSPVTKSFNRGEC |
| 396 | XENP010649 | CK-v23 | RTVAAPSVFIFPPSDEQLESGTASVVCLLNNFYPREAEVQWK |

Figure 93 (cont.)

| | | | |
|---|---|---|---|
| | | | VDNALQSGNSQESVTEQDSEDSTYSLSSTLTLSKADYEKHKV YACEVTHQGLESPVTKSFNRGEC |
| 397 | XENP010650 | CK-v12 | RTVAAPSVFIFPPSDEQLKSGTASVVCLLNNFYPREAEVQWK VDNALQSGNSQESVTEQDSEDSTYSLSSTLTLSKADYEKHKV YACEVTHQGLSSPVTKSFNRGEC |
| 398 | XENP010651 | CK-v23 | RTVAAPSVFIFPPSDEQLESGTASVVCLLNNFYPREAEVQWK VDNALQSGNSQESVTEQDSEDSTYSLSSTLTLSKADYEKHKV YACEVTHQGLESPVTKSFNRGEC |
| 399 | XENP010780 | Ck-WT | RTVAAPSVFIFPPSDEQLKSGTASVVCLLNNFYPREAKVQWK VDNALQSGNSQESVTEQDSKDSTYSLSSTLTLSKADYEKHKV YACEVTHQGLSSPVTKSFNRGEC |
| 400 | XENP010781 | Ck-WT | RTVAAPSVFIFPPSDEQLKSGTASVVCLLNNFYPREAKVQWK VDNALQSGNSQESVTEQDSKDSTYSLSSTLTLSKADYEKHKV YACEVTHQGLSSPVTKSFNRGEC |
| 401 | XENP010782 | Ck-WT | RTVAAPSVFIFPPSDEQLKSGTASVVCLLNNFYPREAKVQWK VDNALQSGNSQESVTEQDSKDSTYSLSSTLTLSKADYEKHKV YACEVTHQGLSSPVTKSFNRGEC |

HETERODIMERIC HUMAN IGG1 POLYPEPTIDES WITH ISOELECTRIC POINT MODIFICATIONS

CROSS-REFERENCE TO RELATED APPLICATIONS

This application claims the benefit of U.S. Provisional Application Ser. No. 61/545,498, filed Oct. 10, 2011 and 61/598,686, filed Feb. 14, 2012 and 61/593,846, filed Feb. 1, 2012, and is also a continuation-in-part of U.S. Ser. No. 13/568,028 filed Aug. 6, 2012, which are incorporated herein by reference in their entirety.

FIELD OF THE INVENTION

Methods for purifying the desired heterodimer species from contaminating homodimer antibody variants by modifying the isoelectric point are provided.

SEQUENCE LISTING

The instant application contains a Sequence Listing which has been submitted electronically in ASCII format and is hereby incorporated by reference in its entirety. Said ASCII copy, created on Mar. 5, 2019, is named 067461_5148US_Revised_SL_ST25.txt and is 1,064,685 bytes in size.

BACKGROUND OF THE INVENTION

Antibodies are immunological proteins that bind a specific antigen. In most mammals, including humans and mice, antibodies are constructed from paired heavy and light polypeptide chains. Each chain is made up of individual immunoglobulin (Ig) domains, and thus the generic term immunoglobulin is used for such proteins. Each chain is made up of two distinct regions, referred to as the variable and constant regions. The light and heavy chain variable regions show significant sequence diversity between antibodies, and are responsible for binding the target antigen. The constant regions show less sequence diversity, and are responsible for binding a number of natural proteins to elicit important biochemical events. In humans there are five different classes of antibodies including IgA (which includes subclasses IgA1 and IgA2), IgD, IgE, IgG (which includes subclasses IgG1, IgG2, IgG3, and IgG4), and IgM. The distinguishing feature between these antibody classes is their constant regions, although subtler differences may exist in the V region. IgG antibodies are tetrameric proteins composed of two heavy chains and two light chains. The IgG heavy chain is composed of four immunoglobulin domains linked from N- to C-terminus in the order VH-CH1-CH2-CH3, referring to the heavy chain variable domain, heavy chain constant domain 1, heavy chain constant domain 2, and heavy chain constant domain 3 respectively (also referred to as VH-Cγ1-Cγ2-Cγ3, referring to the heavy chain variable domain, constant gamma 1 domain, constant gamma 2 domain, and constant gamma 3 domain respectively). The IgG light chain is composed of two immunoglobulin domains linked from N- to C-terminus in the order VL-CL, referring to the light chain variable domain and the light chain constant domain respectively.

Antibodies have serum half-lives in vivo ranging from one to three weeks. This favorable property is due to the preclusion of kidney filtration due to the large size of the full-length molecule, and interaction of the antibody Fc region with the neonatal Fc receptor FcRn. Binding to FcRn recycles endocytosed antibody from the endosome back to the bloodstream (Raghavan et al., 1996, Annu Rev Cell Dev Biol 12:181-220; Ghetie et al., 2000, Annu Rev Immunol 18:739-766, both entirely incorporated by reference).

Other properties of the antibody may determine its clearance rate (e.g. stability and half-life) in vivo. In addition to antibody binding to the FcRn receptor, other factors that contribute to clearance and half-life are serum aggregation, enzymatic degradation in the serum, inherent immunogenicity of the antibody leading to clearing by the immune system, antigen-mediated uptake, FcR (non-FcRn) mediated uptake and non-serum distribution (e.g. in different tissue compartments).

Recently it has been suggested that antibodies with variable regions that have lower isoelectric points may also have longer serum half-lives (Igawa et al., 2010 PEDS. 23(5): 385-392; US Publication 2011/0076275 both of which are entirely incorporated by reference). However, the mechanism of this is still poorly understood, and in fact the authors suggest that engineering the variable region is an alternative to engineering the Fc region. Moreover, variable regions differ from antibody to antibody. As such, each variable region must be altered without significantly affecting the binding affinity.

Accordingly, the present application defines the impact of charge state on antibody pharmacokinetics, and provides novel engineered variants in the constant regions to improve serum half-life.

BRIEF SUMMARY OF THE INVENTION

Accordingly, one problem to be solved is to increase serum half life of antibodies by altering the constant domains, thus allowing the same constant regions to be used with different antigen binding sequences, e.g. the variable regions including the CDRs, and minimizing the possibility of immunogenic alterations. Thus providing antibodies with constant region variants with reduced pI and extended half-life provides a more modular approach to improving the pharmacokinetic properties of antibodies, as described herein. In addition, due to the methodologies outlined herein, the possibility of immunogenicity resulting from the pI variants is significantly reduced by importing pI variants from different IgG isotypes such that pI is reduced without introducing significant immunogenicity. Thus, an additional problem to be solved is the elucidation of low pI constant domains with high human sequence content, e.g. the minimization or avoidance of non-human residues at any particular position.

A further problem to be solved is that of purifying a desired antibody heterodimer species from the mixture obtained after transfection and standard Protein A chromatographic purification. The disadvantage of many methods for making heterodimeric antibodies such as heterodimeric Fc mutations (as described in US2011/0054151A1 and Gunasekaran et al., 2010 JBC. 285(25): 19637-19646) and "knobs-into-holes" formats (Ridgway et al., 1996 Protein Engineering. 9(7): 617-621; Atwell et al., 1997 JMB. 270, 26-35; Merchant et al., 1998 Nature Biotech. 16, 677-681) is that these formats can result in production of a significant amount of undesirable homodimers, thus necessitating further and often difficult purification steps, especially since the contaminating species are nearly identical to the desired species in many of their properties (molecular weight, etc.). By engineering each chain such that the difference in isoelectric points between the desired heterodimer species and the contaminating homodimeric species is increased, a simple method of obtaining the desired species in high yield by methods that purify based on charge (e.g., ion exchange chromatography) can be used to obtain the desired heterodimer in high yield.

Accordingly, the present invention provides compositions comprising a heterodimer protein comprising a first and second monomer. The first monomer comprises a first variant heavy chain constant region and a first fusion partner, and the second monomer comprises a second variant heavy chain constant region with a second fusion partner, wherein the pIs of the first and second variant heavy chain constant regions are at least 0.5 logs apart.

In some embodiments, the fusion partners are independently and optionally selected from the group consisting of an immunoglobulin component, a peptide, a cytokine, a chemokine, an immune receptor and a blood factor. Preferred immunoglobulin components include selected from the group consisting of Fab, VH, VL, scFv, scFv2, dAb, different heavy chain variable regions (e.g. to form more traditional bispecific antibodies), as well as different single chain Fv regions. In a preferred embodiment, each monomer is a full-length heavy chain.

An additional aspect of the invention is where the pIs of the first and second monomer are at least 0.5 logs apart. Alternatively, the pIs of the first and second variant heavy chain constant regions are at least 0.5 logs apart.

In a further aspect, additional fusion partners are added to the first and/or second monomers.

In an additional aspect, the invention provides variant heavy chain constant regions comprises an amino acid substitution selected from the group consisting of Q196K, P217R, P228R, N276K, H435R and Y436F. In further aspects, one of the variant heavy chain constant regions further comprises a variant selected from the group consisting of S119E, K133E, K133Q, R133E (in case of IgG2-4), R133Q (in case of IgG2-4), T164E, K205E, K205Q, N208D, K210E, K210Q, K274E, K320E, K322E, K326E, K334E, R355E, K392E, Deletion of K447, adding peptide DEDE at the c-terminus, G137E, N203D, K274Q, R355Q, K392N and Q419E, 349A, 349C, 349E, 349I, 349K, 349S, 349T, 349W, 351E, 351K, 354C, 356K, 357K, 364C, 364D, 364E, 364F, 364G, 364H, 364R, 364T, 364Y, 366D, 366K, 366S, 366W, 366Y, 368A, 368E, 368K, 368S, 370C, 370D, 370E, 370G, 370R, 370S, 370V, 392D, 392E, 394F, 394S, 394W, 394Y, 395T, 395V, 396T, 397E, 397S, 397T, 399K, 401K, 405A, 405S, 407T, 407V, 409D, 409E, 411D, 411E, 411K, 439D, 349C/364E, 349K/351K, 349K/351K/394F, 349K/354C, 349K/394F, 349K/394F/401K, 349K/394Y, 349K/401K, 349K/405A, 349T/351E/411E, 349T/394F, 349T/394F/401K, 349T/394F/411E, 349T/405A, 349T/411E, 351E/364D, 351E/364D/405A, 351E/364E, 351E/366D, 351K/364H/401K, 351K/366K, 364D/370G, 364D/394F, 364E/405A, 364E/405S, 364E/411E, 364E/411E/405A, 364H/394F, 364H/401K, 364H/401K/405A, 364H/405A, 364H/405A/411E, 364Y/370R, 370E/411E, 370R/411K, 395T/397S/405A and 397S/405A.

In additional aspects, the heterodimeric antibodies include light chains, including variant light chains. In some aspects, the variant light chain comprising an amino acid substitution selected from the group consisting of K126E, K126Q, K145E, K145Q, N152D, S156E, K169E, S202E, K207E, an addition of DEDE at the C-terminus, R108Q, Q124E, K126Q, N138D, K145T and Q199E.

In some aspects, the first and second variant heavy chain constant region comprises CH2 and CH3. In additional aspects, they comprise CH1, CH2 and CH3 with optional hinge regions.

In a further aspect, the invention provides methods for modifying the isoelectric point of an antibody monomer by introducing at least 6 amino acid mutations, including substitutions with non-native amino acids in a constant domain selected from the heavy chain constant domain and light chain constant domain, wherein the substituted amino acids have a pI lower than the native amino acid, such that said isoelectric point of the variant antibody is lowered by at least 0.5 logs. In some cases, only the heavy chain constant domain is altered; in some cases, only the light chain constant domain, and in some cases both the heavy and light constant domains comprise mutated amino acids.

In another aspect the methods provide for the generation of these variants by amino acid mutations selected from the group consisting of a non-native glutamic acid at position 119; a non-native cysteine at position 131; a non-native arginine, lysine or glutamine at position 133; a non-native glutamic acid at position 137; a non-native serine at position 138; a non-native glutamic acid at position 164; a non native asparagine at position 192; a non native phenylalanine at position 193, a non-native lysine at position 196, a non-native threonine at position 199, a non-native aspartic acid at position 203, a non-native glutamic acid or glutamine at position 205, a non native aspartic acid at position 208, a non-native glutamic acid or glutamine at position 210, a non native threonine at position 214, a non native arginine at position 217 and a non-native cysteine at position 219, a deletion at position 221, a non-native valine or threonine at position 222, a deletion at position 223, a non-native glutamic acid at position 224, a deletion at position 225, a deletion at position 235, a non-native glutamine or glutamic acid at position 274, a non-native phenylalanine at position 296, a non native phenylalanine at position 300, a non-native valine at position 309, a non-native glutamic acid at position 320, a non-native glutamic acid at position 322, a non-native glutamic acid at position 326, a non-native glycine at position 327, a non-native glutamic acid at position 334, a non native threonine at position 339, a non native glutamine or glutamic acid at position 355, a non-native serine at position 384, a non-native asparagine or glutamic acid at position 392, a non-native methionine at position 397, a non native glutamic acid at position 419, and a deletion or non-native aspartic acid at position 447, using EU numbering.

In a further aspect, the invention provides methods for modifying the isoelectric point of an antibody by introducing at least 2 amino acid mutations in the light constant domain, such that said isoelectric point of the variant antibody is lowered by at least 0.5 logs, and wherein said variant antibody comprises substitutions selected from the group consisting of a non-native glutamine or glutamic acid at position 126, a non-native glutamine, glutamic acid or threonine at position 145; a non-native aspartic acid at position 152, a non-native glutamic acid at position 156, a non-native glutamine or glutamic acid at position 169, a non-native glutamic acid at position 199, a non-native glutamic acid at position 202 and a a non-native glutamic acid at position 207 (using EU numbering).

In additional aspects, the invention provides methods for modifying the isoelectric point of an antibody by introducing: a) at least 6 amino acid mutations in the heavy constant domain, wherein said variant antibody comprises mutations selected from the group consisting of a non-native glutamic acid at position 119; a non-native cysteine at position 131; a non-native arginine, lysine or glutamine at position 133; a non-native glutamic acid at position 137; a non-native serine at position 138; a non-native glutamic acid at position 164; a non native asparagine at position 192; a non native phenylalanine at position 193, a non-native lysine at position 196, a non-native threonine at position 199, a non-native aspartic acid at position 203, a non-native glutamic acid or glutamine at position 205, a non native aspartic acid at position 208, a non-native glutamic acid or glutamine at position 210, a non-native threonine at position 214, a non native arginine at position 217 and a non-native cysteine at position 219, a deletion at position 221, a non-native valine or threonine at position 222, a deletion at position 223, a non-native glutamic acid at position 224, a deletion at position 225, a deletion at position 235, a non-native glutamine or glutamic acid at position 274, a non-native phenylalanine at position 296, a non native phenylalanine at position 300, a non-native valine at position 309, a non-native glutamic acid at position 320, a non-native glutamic acid at position 322, a non-native glutamic acid at position 326, a non-native glycine at position 327, a non-native glutamic acid at position 334, a non native threonine at position 339, a non native glutamine or glutamic acid at position 355, a non-native serine at position 384, a non-native asparagine or glutamic acid at position 392, a non-native methionine at position 397, a non native glutamic acid at position 419, and a deletion or non-native aspartic acid at position 447; and b) substituting at least 2 non-native amino acids in the light constant domain, wherein said variant antibody comprises substitutions selected from the group consisting of a non-native glutamine or glutamic acid at position 126, a non-native glutamine, glutamic acid or threonine at position 145; a non-native aspartic acid at position 152, a non-native glutamic acid at position 156, a non-native glutamine or glutamic acid at position 169, a non-native glutamic acid at position 199, a non-native glutamic acid at position 202 and a a non-native glutamic acid at position 207 (using EU numbering), such that said isoelectric point of the variant antibody is lowered by at least 0.5 logs.

In a further aspect, the invention provides nucleic acids encoding the antibodies, including a nucleic acid encoding a variant heavy chain constant domain and/or a nucleic acid encoding a variant light chain constant domain. Host cells containing the nucleic acids and methods of producing the antibodies are also included.

In an additional aspect, the invention provides antibodies comprising a variant heavy chain constant domain having the formula:

[SEQ. ID NO: 403]
A-$X_{119}$-T-K-G-P-S-V-F-P-L-A-P-$X_{131}$-S-$X_{133}$-S-T-S-

$X_{137}$-$X_{138}$-T-A-A-L-G-C-L-V-K-D-Y-F-P-E-P-V-T-V-S-W-

N-S-G-A-L-$X_{164}$-S-G-V-H-T-F-P-A-V-L-Q-S-S-G-L-Y-S-

L-S-S-V-V-T-V-P-S-S-$X_{192}$-$X_{193}$-G-T-$X_{196}$-T-Y-$X_{199}$-C-

N-V-$X_{203}$-H-$X_{205}$-P-S-$X_{208}$-T-$X_{210}$-V-D-K-$X_{214}$-V-E-

$X_{217}$-K-$X_{219}$-C-$X_{221}$-$X_{222}$-$X_{223}$-$X_{224}$-$X_{225}$-C-P-P-C-P-

A-P-$X_{233}$-$X_{234}$-$X_{235}$-$X_{236}$-G-P-S-V-F-L-F-P-P-K-P-K-D-

T-L-M-I-S-R-T-P-E-V-T-C-V-V-V-D-V-S-H-E-D-P-E-V-

$X_{274}$-F-N-W-Y-V-D-G-V-E-V-H-N-A-K-T-K-P-R-E-E-Q-

$X_{296}$-N-S-T-$X_{300}$-R-V-V-S-V-L-T-V-$X_{309}$-H-Q-D-W-L-N-

G-K-E-Y-$X_{320}$-C-$X_{322}$-V-S-N-$X_{326}$-$X_{327}$-L-P-A-P-I-E-

$X_{334}$-T-I-S-K-$X_{339}$-K-G-Q-P-R-E-P-Q-V-Y-T-L-P-P-S-

$X_{355}$-E-E-M-T-K-N-Q-V-S-L-T-C-L-V-K-G-F-Y-P-S-D-I-

A-V-E-W-E-S-$X_{384}$-G-Q-P-E-N-N-Y-$X_{392}$-T-T-P-P-$X_{397}$-

L-D-S-D-G-S-F-F-L-Y-S-K-L-T-V-D-K-S-R-W-Q-$X_{419}$-G-

N-V-F-S-C-S-V-$X_{428}$-H-E-A-L-H-$X_{434}$-H-Y-T-Q-K-S-L-

S-L-S-P-G-$X_{447}$, wherein $X_{119}$ is selected from the group consisting of S and E;

wherein $X_{131}$ is selected from the group consisting of S and C;

wherein $X_{133}$ is selected from the group consisting of K, R, E, and Q;

wherein $X_{137}$ is selected from the group consisting of G and E;

wherein $X_{138}$ is selected from the group consisting of G and S;

wherein $X_{164}$ is selected from the group consisting of T and E;

wherein $X_{192}$ is selected from the group consisting of S and N;

wherein $X_{193}$ is selected from the group consisting of L and F;

wherein $X_{196}$ is selected from the group consisting of Q and K;

wherein $X_{199}$ is selected from the group consisting of I and T;

wherein $X_{203}$ is selected from the group consisting of N and D;

wherein $X_{205}$ is selected from the group consisting of K, E, and Q;

wherein $X_{208}$ is selected from the group consisting of N and D;

wherein $X_{210}$ is selected from the group consisting of K, E, and Q;

wherein $X_{214}$ is selected from the group consisting of K and T;

wherein $X_{217}$ is selected from the group consisting of P and R;

wherein $X_{219}$ is selected from the group consisting of S and C;

wherein $X_{220}$ is selected from the group consisting of C, PLG, and G;

wherein $X_{221}$ is selected from the group consisting of D and a deletion;

wherein $X_{222}$ is selected from the group consisting of K, V, and T;

wherein $X_{223}$ is selected from the group consisting of T and a deletion;

wherein $X_{224}$ is selected from the group consisting of H and E;

wherein $X_{225}$ is selected from the group consisting of T and a deletion;

wherein $X_{233}$ is selected from the group consisting of E and P;

wherein $X_{234}$ is selected from the group consisting of L and V;

wherein $X_{235}$ is selected from the group consisting of L, A, and a deletion;

wherein $X_{236}$ is selected from the group consisting of G, A, and a deletion;

wherein $X_{274}$ is selected from the group consisting of K, Q, and E;

wherein $X_{296}$ is selected from the group consisting of Y and F;

wherein $X_{300}$ is selected from the group consisting of Y and F;

wherein $X_{309}$ is selected from the group consisting of L and V;

wherein $X_{320}$ is selected from the group consisting of K and E;

wherein $X_{322}$ is selected from the group consisting of K and E;

wherein $X_{326}$ is selected from the group consisting of K and E;

wherein $X_{327}$ is selected from the group consisting of A and G;

wherein $X_{334}$ is selected from the group consisting of K and E;

wherein $X_{339}$ is selected from the group consisting of A and T;

wherein $X_{355}$ is selected from the group consisting of R, Q, and E;

wherein $X_{384}$ is selected from the group consisting of N and S;

wherein $X_{392}$ is selected from the group consisting of K, N, and E;

wherein $X_{397}$ is selected from the group consisting of V and M;

wherein $X_{419}$ is selected from the group consisting of Q and E;

wherein $X_{428}$ is selected from the group consisting of M and L;

wherein $X_{434}$ is selected from the group consisting of N and S; and wherein $X_{447}$ is selected from the group consisting of K, DEDE, and a deletion;

wherein said variant heavy chain constant domain comprises at least 6 substitutions as compared to SEQ ID NO: 2 and said variant is not SEQ ID NO: 3.

In a further aspect the invention provides variant heavy chain constant domain comprises at least 10 or 15 substitutions as compared to SEQ ID NO: 2.

In an additional aspect, the invention provides antibodies with a variant light chain constant domain having the formula:

[SEQ ID NO: 404]
$X_{108}$-T-V-A-A-P-S-V-F-I-F-P-P-S-D-E-$X_{124}$-L-$X_{126}$-S-

G-T-A-S-V-V-C-L-L-N-$X_{138}$-F-Y-P-R-E-A-$X_{145}$-V-Q-W-K-

V-D-$X_{152}$-A-L-Q-$X_{156}$-G-N-S-Q-E-S-V-T-E-Q-D-S-$X_{169}$-

D-S-T-Y-S-L-S-S-T-L-T-L-S-K-A-D-Y-E-K-H-K-V-Y-A-C-

E-V-T-H-$X_{199}$-G-L-$X_{202}$-S-P-V-T-$X_{207}$-S-F-N-R-G-E-

$X_{214}$, wherein $X_{108}$ is selected from the group consisting of R and Q;

wherein $X_{124}$ is selected from the group consisting of Q and E;

wherein $X_{126}$ is selected from the group consisting of K, E, and Q;

wherein $X_{138}$ is selected from the group consisting of N and D;

wherein $X_{145}$ is selected from the group consisting of K, E, Q, and T;

wherein $X_{152}$ is selected from the group consisting of N and D;

wherein $X_{156}$ is selected from the group consisting of S and E;

wherein $X_{169}$ is selected from the group consisting of K, E, and Q;

wherein $X_{199}$ is selected from the group consisting of Q and E;

wherein $X_{202}$ is selected from the group consisting of S and E; and wherein $X_{207}$ is selected from the group consisting of K and E; and wherein $X_{214}$ is selected from the group consisting of C and CDEDE.

wherein said variant light chain constant domain comprises at least 2 substitutions as compared to SEQ ID NO: 112.

BRIEF DESCRIPTION OF THE DRAWINGS

FIG. 1. [SEQ ID NOS: 1-6] Amino acid sequences of wild-type constant regions used in the invention.

FIG. 2. [SEQ ID NOS: 411-414] Engineering of heavy chain CH1 domains. List of CH1 residues for the four IgG isotypes, fraction exposed, and examples of substitutions that can be made to lower pI. Numbering is according to the EU index.

FIG. 3. [SEQ ID NO: 415] Engineering of light chain CK domains. List of CK residues, fraction exposed, and substitutions that can be made to lower pI. Numbering is according to the EU index.

FIG. 4. [SEQ ID NOS: 7-8, 52-53] Amino acid sequences of pI engineered constant regions IgG1-CH1-pI(6) and CK-pI(6).

FIG. 5. [SEQ ID NOS: 9-10] Amino acid sequences of wild-type anti-VEGF VH and VL variable regions used in the invention.

FIG. 6. [SEQ ID NOS: 11-12] Amino acid sequences of the heavy and light chains of pI engineered anti-VEGF antibody XENP9493 IgG1-CH1-pI(6)-CK-pI(6) used in the invention.

FIG. 11. Binding analysis (BIACORE®) of bevacizumab and pI engineered anti-VEGF binding to VEGF.

FIG. 17. [SEQ ID NOS: 426-429] Amino acid sequence alignment of the IgG subclasses. Residues with a bounded box illustrate isotypic differences between the IgG's. Residues which contribute to a higher pI (K, R, and H) or lower pI (D and E) are highlighted in bold. Designed substitutions that either lower the pI, or extend an epitope are shown in gray.

FIG. 18. Amino acid sequence of the CK [SEQ ID NO. 443] and Cλ [SEQ ID NO. 444] light constant chains. Residues which contribute to a higher pI (K, R, and H) or lower pI (D and E) are highlighted in bold. Preferred positions that can be modified to lower the pI are shown in gray.

FIG. 19. [SEQ ID NOS: 13-16, 50-51, 55-57, 405-407] Amino acid sequences of pI-engineered variant heavy chains.

FIG. 20. [SEQ ID NOS: 17-18, 54, 58-60, 408-410] Amino acid sequences of pI-engineered variant light chains.

FIG. 24. [SEQ ID NOS: 418-422] Amino acid sequence alignment of novel isotype IgG-pI-Iso3 with the IgG subclasses. Blue indicates a match between pI-iso3 and residues in the four native IgG's IgG1, IgG2, IgG3, and IgG4. Residues with a bounded box illustrate IgG isotypic differences that have been incorporated into IgG-pI-Iso3 that reduce pI.

FIG. 27. [SEQ ID NO: 423] Amino acid illustration of the CK-pI(4) variant. Red indicates lysine to glutamic acid charge substitutions relative to the native CK light constant chain.

FIG. 28. [SEQ ID NOS: 19-33, 61-69] Amino acid sequences of pI-engineered heavy and light constant chains.

FIG. 29. Analysis of basic residues in the antibody Fc region showing fraction exposed and the calculated energy for substitution to Glu normalized against the energy of the WT residue. Basic residues with a high fraction exposed and a favorable delta E for substitution to Glu are targets for charge swap mutations to lower pI.

FIG. 36. Literature pIs of the 20 amino acids. It should be noted that the listed pIs are calculated as free amino acids; the actual pI of any side chain in the context of a protein is different, and thus this list is used to show pI trends and not absolute numbers for the purposes of the invention.

FIG. 37. Data table of exemplary pI-engineered variants listing:

| | |
|---|---|
| XenP# | the internal reference number |
| Name (HC) | heavy chain sequence designation |
| SEQ ID NO (HC) | corresponding SEQ ID NO of the heavy chain sequence |
| Name (LC) | light chain sequence designation |
| SEQ ID NO (LC) | corresponding SEQ ID NO of the light chain sequence |
| Calc. pI | calculated pI value for the entire antibody sequence, including heavy and light chain Fv + constant domains, with the Fv of bevacizumab and the constant domains as defined in the table |
| # KR | number of Lys or Arg residues in IgG1 with the Fv of bevacizumab and the constant domains as defined in the table |
| Delta KR (vs. WT) | change in the number of Lys or Arg residues relative to IgG1 wild-type sequence of bevacizumab |
| # DE | number of Asp or Glu residues in IgG1 with the Fv of bevacizumab and the constant domains as defined in the table |
| Delta DE (vs. WT) | change in the number of Asp or Glu acid residues relative to IgG1 wild-type sequence of bevacizumab |
| Charge state | derived from the total number of Lys and Arg minus the total number of Asp and Glu residues, assuming a pH of 7 |
| # HC Mutations vs IgG1 | number of mutations in the heavy chain constant domain as compared to IgG1 |
| # LC Mutations vs IgG1 | number of mutations in the light chain constant domain as compared to IgG1 |
| Total # of Mutations | total number of mutations in the heavy chain and light chain constant domains as compared to IgG1 |

Figure 38:
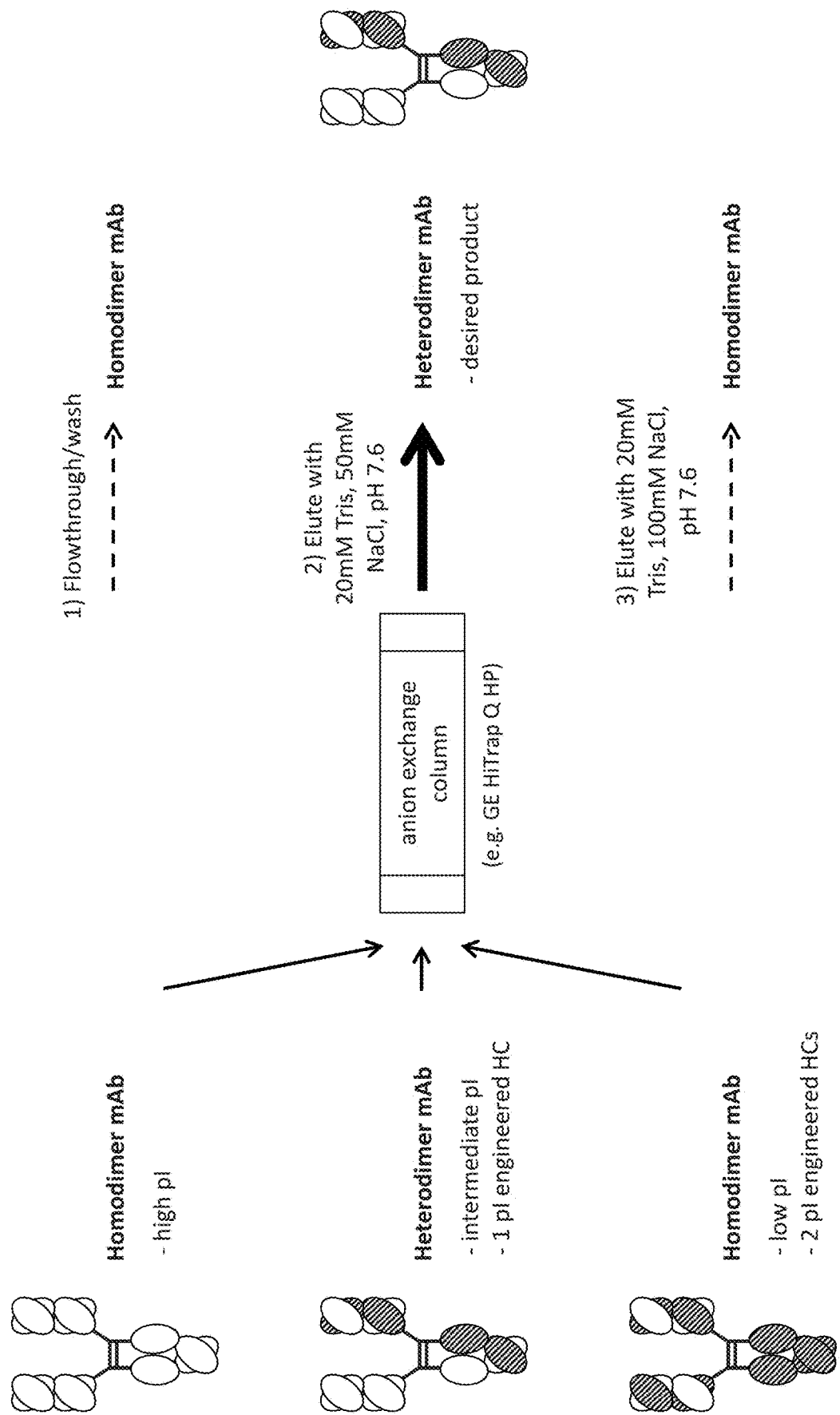

FIG. 38. Outline of method of purifying a desired heterodimeric antibody species from a mixture of contaminating homodimer species by engineering to modify isoelectric points of individual chains.

FIG. 39. [SEQ ID NOS: 34-49, 70-73] Sequences of pI-engineered variants, including heterodimeric and bispecific constructs.

FIG. 40. IEF gel showing purification of the heterodimer species of the pI engineered variant XENP10653 from the homodimer species by anion exchange chromatography. As can be seen from lane 3, the desired heterodimer is obtained in high purity.

Figure 41:
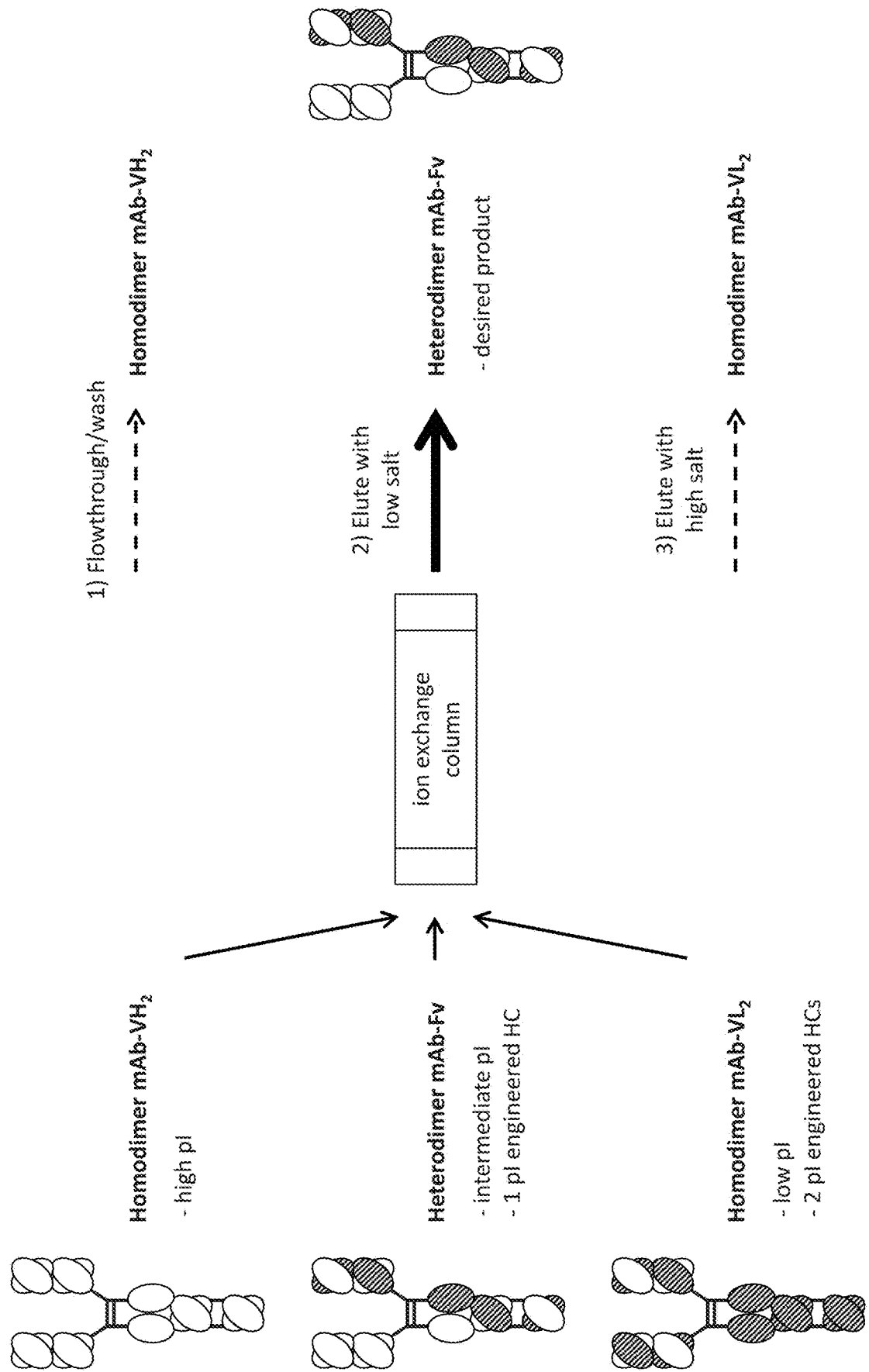

FIG. 41. Outline of method of purifying a desired heterodimeric bispecific mAb-Fv from a mixture of contaminating homodimer species by engineering to modify isoelectric points of individual chains.

Figure 42:
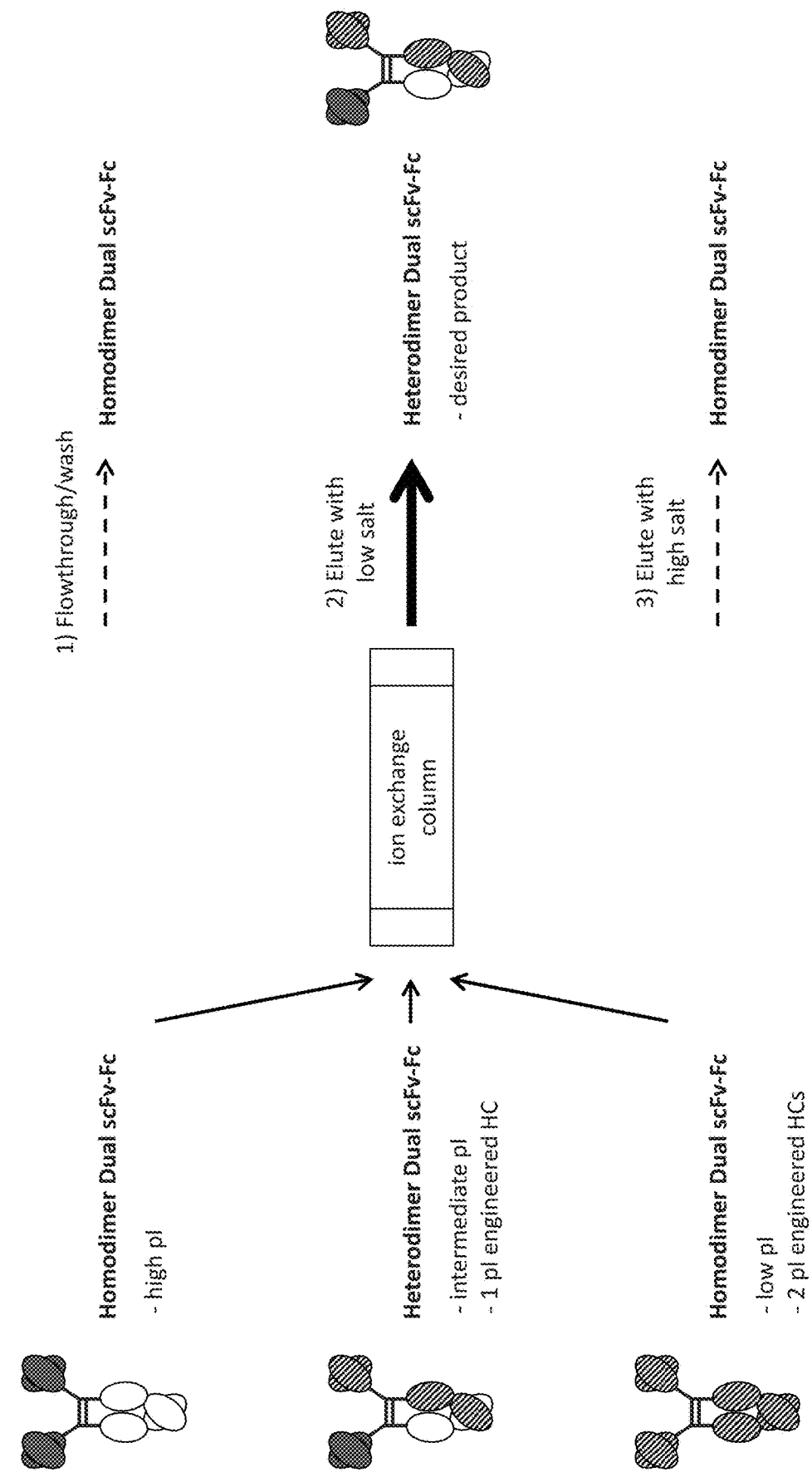

FIG. 42. Outline of method of purifying a desired heterodimeric bispecific dual scFv-Fc from a mixture of contaminating homodimer species by engineering to modify isoelectric points of individual chains.

FIG. 43. [SEQ ID NOS: 425 and 442] List of heavy chain and light chain residues for human IgG1 and percent exposed surface area. Numbering is according to the EU index.

FIG. 44. Examples of acidic substitutions that can be made in the heavy chain to faciliate easy purification of a heterodimeric species. Calculated pI in the context of bevacizumab are listed for zero-substitution homodimer (IgG1/IgG1), one-substitution pI-engineered heterodimer (pI/IgG1), and two-substitution pI-engineered homodimer (pI/pI). The average difference in pI of the heterodimer from the homodimers (delta pI) is also listed.

FIG. 45. Examples of basic to neutral substitutions that can be made in the heavy chain to faciliate easy purification of a heterodimeric species. Calculated pI in the context of bevacizumab are listed for zero-substitution homodimer (IgG1/IgG1), one-substitution pI-engineered heterodimer (pI/IgG1), and two-substitution pI-engineered homodimer (pI/pI). The average difference in pI of the heterodimer from the homodimers (delta pI) is also listed.

FIG. 46. Examples of basic substitutions that can be made in the heavy chain to faciliate easy purification of a heterodimeric species. Calculated pI in the context of bevacizumab are listed for zero-substitution homodimer (IgG1/IgG1), one-substitution pI-engineered heterodimer (pI/IgG1), and two-substitution pI-engineered homodimer (pI/pI). The average difference in pI of the heterodimer from the homodimers (delta pI) is also listed.

FIG. 47. Examples of acidic to neutral substitutions that can be made in the heavy chain to faciliate easy purification of a heterodimeric species. Calculated pI in the context of bevacizumab are listed for zero-substitution homodimer (IgG1/IgG1), one-substitution pI-engineered heterodimer (pI/IgG1), and two-substitution pI-engineered homodimer (pI/pI). The average difference in pI of the heterodimer from the homodimers (delta pI) is also listed.

FIG. 48. Examples of acidic substitutions that can be made in the light chain to faciliate easy purification of a heterodimeric species. Calculated pI in the context of bevacizumab are listed for zero-substitution homodimer (IgG1/IgG1), one-substitution pI-engineered heterodimer (pI/IgG1), and two-substitution pI-engineered homodimer (pI/pI). The average difference in pI of the heterodimer from the homodimers (delta pI) is also listed.

FIG. 49. Examples of basic to neutral substitutions that can be made in the light chain to faciliate easy purification of a heterodimeric species. Calculated pI in the context of bevacizumab are listed for zero-substitution homodimer (IgG1/IgG1), one-substitution pI-engineered heterodimer (pI/IgG1), and two-substitution pI-engineered homodimer (pI/pI). The average difference in pI of the heterodimer from the homodimers (delta pI) is also listed.

FIG. 50. Examples of basic substitutions that can be made in the light chain to faciliate easy purification of a heterodimeric species. Calculated pI in the context of bevacizumab are listed for zero-substitution homodimer (IgG1/IgG1), one-substitution pI-engineered heterodimer (pI/IgG1), and two-substitution pI-engineered homodimer (pI/pI). The average difference in pI of the heterodimer from the homodimers (delta pI) is also listed.

FIG. 51. Examples of acidic to neutral substitutions that can be made in the light chain to faciliate easy purification of a heterodimeric species. Calculated pI in the context of bevacizumab are listed for zero-substitution homodimer (IgG1/IgG1), one-substitution pI-engineered heterodimer (pI/IgG1), and two-substitution pI-engineered homodimer (pI/pI). The average difference in pI of the heterodimer from the homodimers (delta pI) is also listed.

FIG. 52. [SEQ ID NOS: 430-441] Sequence alignment of the identified heavy chain constant domains (including IgG1, IgG2, IgG3, IgG4, iso1, iso2, iso3, ISO(-), ISO(+RR), ISO(+)). For IgG1, IgG2, IgG3, and IgG4, differences from the IgG1 sequence are highlighted in grey. For isotypic pI variants, differences from IgG1 are shown in black with white text.

FIG. 53. [SEQ ID NOS: 74-79] Sequences of ISO(-), ISO(+), ISO(+RR), Anti-VEGF ISO(-) heavy chain, Anti-VEGF ISO(+) heavy chain, and Anti-VEGF ISO(+RR) heavy chain.

FIG. 54. [SEQ ID NOS: 80-82] Sequence of XENP10783, Anti-VEGF ISO(-) x IgG1(WT). Also listed are the three expected species and their respective pI after transfection and protein A purification.

FIG. 55. [SEQ ID NOS: 83-85] Sequence of XENP10784, Anti-VEGF ISO(+RR) x IgG1(WT). Also listed are the three expected species and their respective pI after transfection and protein A purification.

FIG. 56. [SEQ ID NOS: 86-88] Sequence of XENP10896, Anti-VEGF ISO(-) x ISO(+RR). Also listed are the three expected species and their respective pI after transfection and protein A purification.

FIG. 57. [SEQ ID NOS: 89-91] Sequence of XENP10901, Anti-VEGF ISO(-) x ISO(+). Also listed are the three expected species and their respective pI after transfection and protein A purification.

FIG. 58. List of all possible reduced pI variants created from isotypic substitutions of IgG1, IgG2, IgG3, and IgG4. Shown are the pI values for the three expected species as well as the average delta pI between the heterodimer and the two homodimer species present when the variant heavy chain is transfected with IgG1-WT heavy chain.

FIG. 59. List of all possible increased pI variants created from isotypic substitutions of IgG1, IgG2, IgG3, and IgG4. Shown are the pI values for the three expected species as well as the average delta pI between the heterodimer and the two homodimer species present when the variant heavy chain is transfected with IgG1-WT heavy chain.

Figure 60:
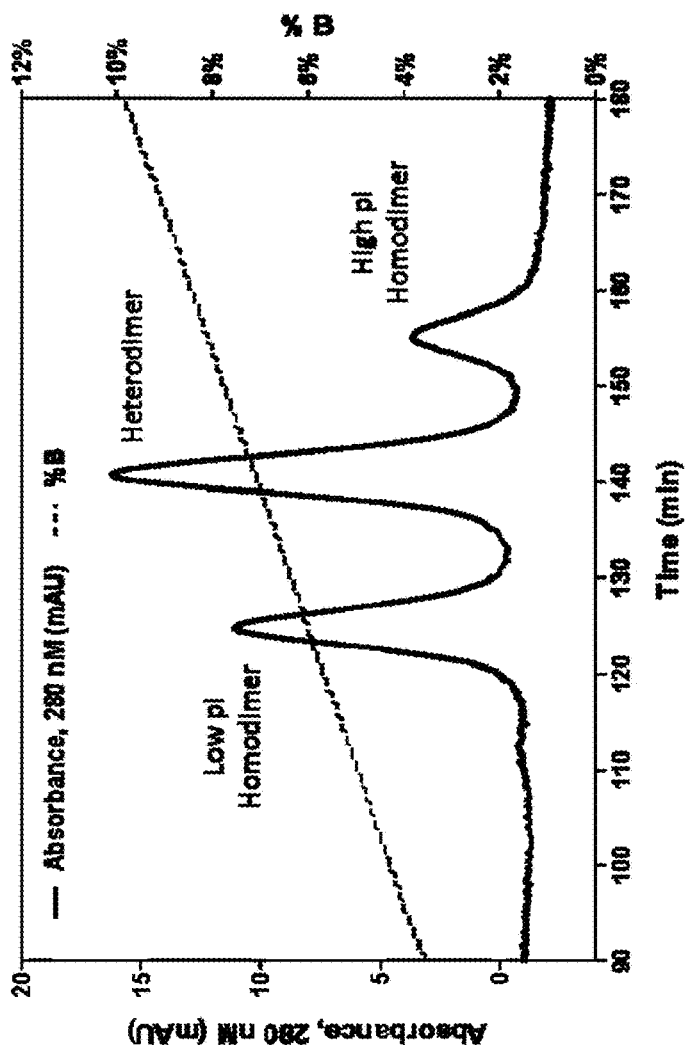

FIG. 60. Chromatogram and IEF gel demonstrating purification of the heterodimer species present when Anti-VEGF ISO(-), IgG1-WT, and Anti-VEGF WT light chain are transfected together. Purification is performed on a HITRAP® SP HP cation exchange column using 50 mM MES @ pH 6.0 and eluted with a linear NaCl gradient (0-130 mM).

Figure 61:
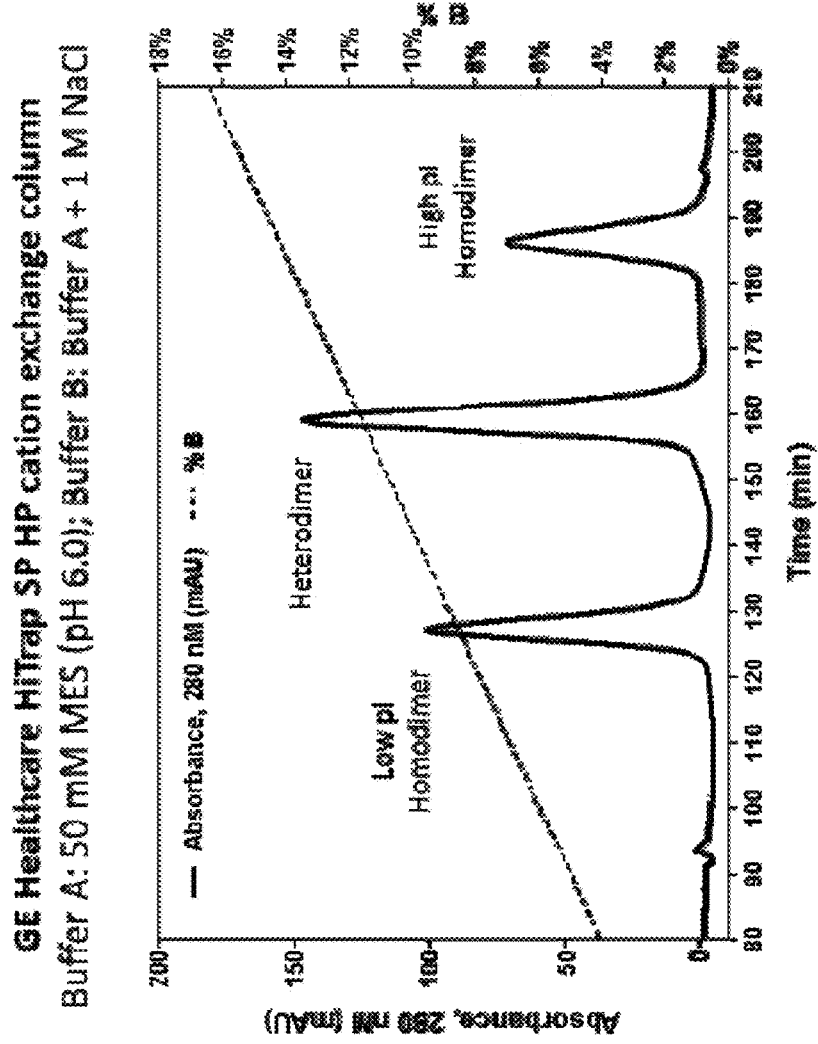

FIG. 61. Chromatogram and IEF gel demonstrating purification of the heterodimer species present when Anti-VEGF ISO(+RR), IgG1-WT, and Anti-VEGF WT light chain are transfected together. Purification is performed on a HITRAP® SP HP cation exchange column using 50 mM MES @ pH 6.0 and eluted with a linear NaCl gradient (0-180 mM).

Figure 62:
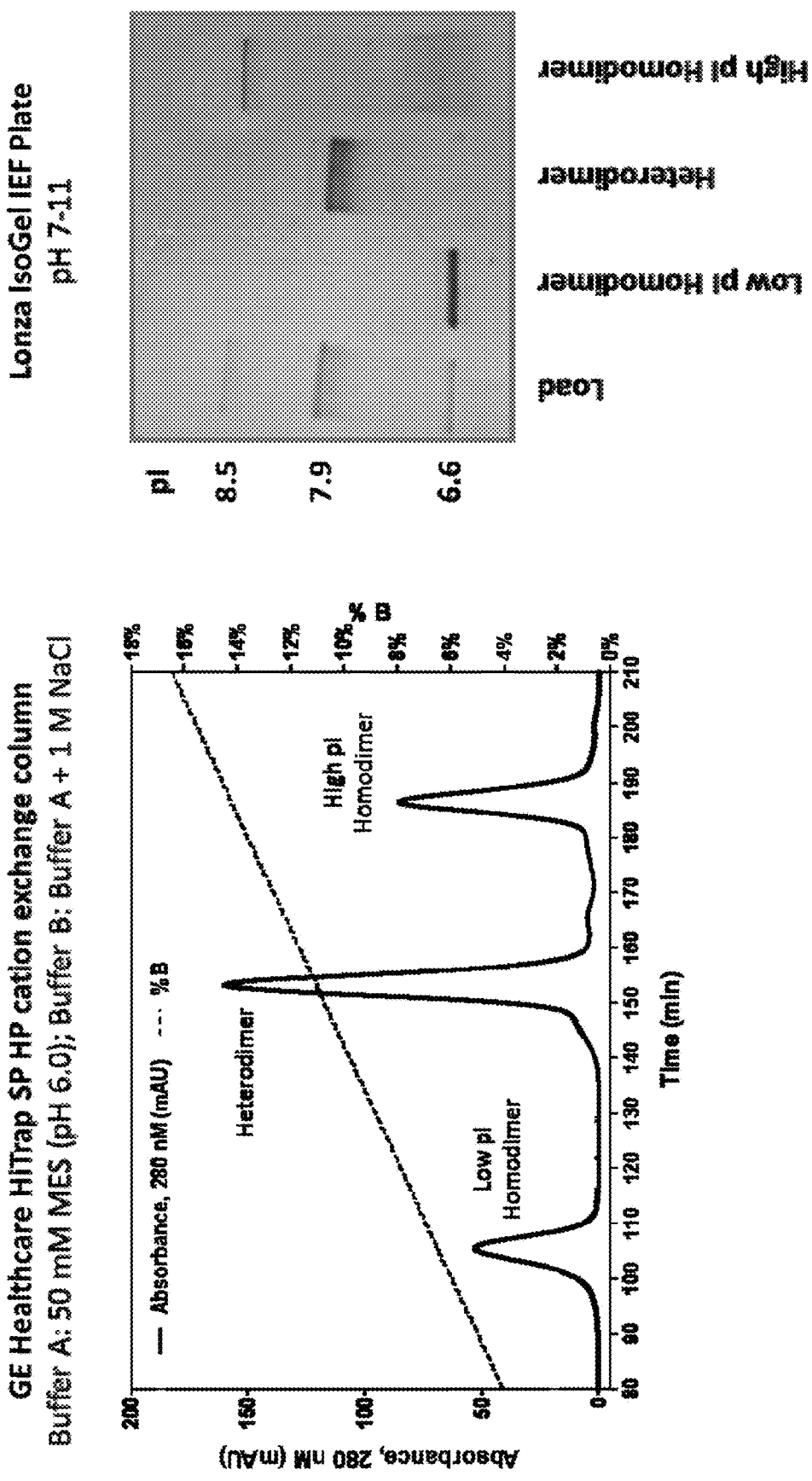

FIG. 62. Chromatogram and IEF gel demonstrating purification of the heterodimer species present when Anti-VEGF ISO(-), ISO(+RR), and Anti-VEGF WT light chain are transfected together. Purification is performed on a HITRAP® SP HP cation exchange column using 50 mM MES @ pH 6.0 and eluted with a linear NaCl gradient (0-180 mM).

FIG. 63. Chromatogram and IEF gel demonstrating purification of the heterodimer species present when Anti-VEGF ISO(-), ISO(+), and Anti-VEGF WT light chain are transfected together. Purification is performed on a HITRAP® SP HP cation exchange column using 50 mM MES @ pH 6.0 and eluted with a linear NaCl gradient (0-180 mM).

Figure 64:
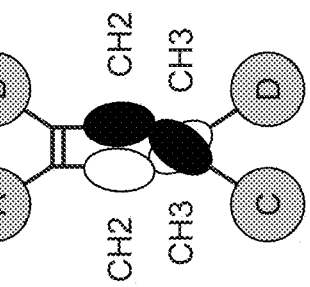

FIG. 64. Structure and sequences of a generic pI-engineered heterodimeric immunoglobulin variant. Domains filled with solid white or solid black may be pI-engineered.

FIG. 65. [SEQ ID NOS: 92-103] Examples of VH and VL regions that can be used to construct possible pI-engineered heterodimeric immunoglobulin variants illustrated in FIG. 64. Complementary-determining regions (CDRs) are underlined.

FIG. 66. [SEQ ID NOS: 104-106] Structure and sequences of an example of a pI-engineered heterodimeric immunoglobulin variant, specifically an anti-CD19 x anti-CD3 mAb-Fv. The calculated pI values of desired heterodimeric and contaminating homodimeric species are listed. Domains that may be pI-engineered are filled with solid white or solid black.

FIG. 67. [SEQ ID NOS: 107-108] Structure and sequences of an example of a pI-engineered heterodimeric immunoglobulin variant, specifically an anti-CD19 x anti-CD3 scFv2-Fc. The calculated pI values of desired heterodimeric and contaminating homodimeric species are listed. Domains that may be pI-engineered are filled with solid white or solid black.

FIG. 68. [SEQ ID NOS: 109-110] Structure and sequences of an example of a pI-engineered heterodimeric immunoglobulin variant, specifically an anti-CD19 x anti-CD3 DART-Fc. The calculated pI values of desired heterodimeric and contaminating homodimeric species are listed. Domains that may be pI-engineered are filled with solid white or solid black.

FIG. 69. [SEQ ID NOS: 111-112] Structure and sequences of an example of a pI-engineered heterodimeric immunoglobulin variant, specifically an anti-CD19 x anti-CD3 dual scFv-Fc. The calculated pI values of desired heterodimeric and contaminating homodimeric species are listed. Domains that may be pI-engineered are filled with solid white or solid black.

FIG. 70. [SEQ ID NOS: 113-115] Structure and sequences of an example of a pI-engineered heterodimeric immunoglobulin variant, specifically an anti-CD19 x anti-CD3 mAb-scFv. The calculated pI values of desired heterodimeric and contaminating homodimeric species are listed. Domains that may be pI-engineered are filled with solid white or solid black.

FIG. 71. [SEQ ID NOS: 116-118] Structure and sequences of an example of a pI-engineered heterodimeric immunoglobulin variant, specifically an anti-CD19 x anti-CD3 mAb-dAb. The calculated pI values of desired heterodimeric and contaminating homodimeric species are listed. Domains that may be pI-engineered are filled with solid white or solid black.

FIG. 72. [SEQ ID NOS: 119-120] Structure and sequences of an example of a pI-engineered heterodimeric immunoglobulin variant, specifically an anti-CD19 x anti-CD3 Fv-Fab-Fc. The calculated pI values of desired heterodimeric and contaminating homodimeric species are listed. Domains that may be pI-engineered are filled with solid white or solid black.

FIG. 73. [SEQ ID NOS: 121-123] Structure and sequences of an example of a pI-engineered heterodimeric immunoglobulin variant, specifically an anti-CD19 x anti-CD3 common light chain mAb. The calculated pI values of desired heterodimeric and contaminating homodimeric species are listed. Domains that may be pI-engineered are filled with solid white or solid black.

FIG. 74. [SEQ ID NOS: 124-126] Structure and sequences of an example of a pI-engineered heterodimeric immunoglobulin variant, specifically an anti-CD3 one-arm mAb. The calculated pI values of desired heterodimeric and contaminating homodimeric species are listed. Domains that may be pI-engineered are filled with solid white or solid black.

FIG. 75. [SEQ ID NOS: 127-128] Structure and sequences of an example of a pI-engineered heterodimeric immunoglobulin variant, specifically an anti-CD19 x anti-CD3 Fab-Fv-Fc. The calculated pI values of desired heterodimeric and contaminating homodimeric species are listed. Domains that may be pI-engineered are filled with solid white or solid black.

FIG. 76. [SEQ ID NOS: 129-130] Structure and sequences of an example of a pI-engineered heterodimeric immunoglobulin variant, specifically an anti-CD19 x anti-CD3 Fv-Fv-Fc. The calculated pI values of desired heterodimeric and contaminating homodimeric species are listed. Domains that may be pI-engineered are filled with solid white or solid black.

FIG. 77. [SEQ ID NOS: 131-132] Structure and sequences of an example of a pI-engineered heterodimeric immunoglobulin variant, specifically an anti-CD3 monovalent mAb. The calculated pI values of desired heterodimeric and contaminating homodimeric species are listed. Domains that may be pI-engineered are filled with solid white or solid black.

FIG. 78. [SEQ ID NOS: 133-135] Structure and sequences of a pI-engineered heterodimeric immunoglobulin variant, specifically an anti-CD19 x anti-CD3 central mAb-Fv. The calculated pI values of desired heterodimeric and contaminating homodimeric species are listed. Domains that may be pI-engineered are filled with solid white or solid black.

FIG. 79. [SEQ ID NOS: 136-137] Structure and sequences of an example of a pI-engineered heterodimeric immunoglobulin variant, specifically an anti-CD19 x anti-CD3 Fab-Fab-Fc. The calculated pI values of desired heterodimeric and contaminating homodimeric species are listed. Domains that may be pI-engineered are filled with solid white or solid black.

FIG. 80. [SEQ ID NOS: 138-139] Structure and sequences of XENP11355, a pI-engineered heterodimeric immunoglobulin variant, specifically an anti-CD19 x anti-CD3 dual scFv-Fc. The calculated pI values of desired heterodimeric and contaminating homodimeric species are listed. Domains that are pI-engineered are filled with solid white (ISO(−)) or solid black (ISO(+RR)).

Figure 81:
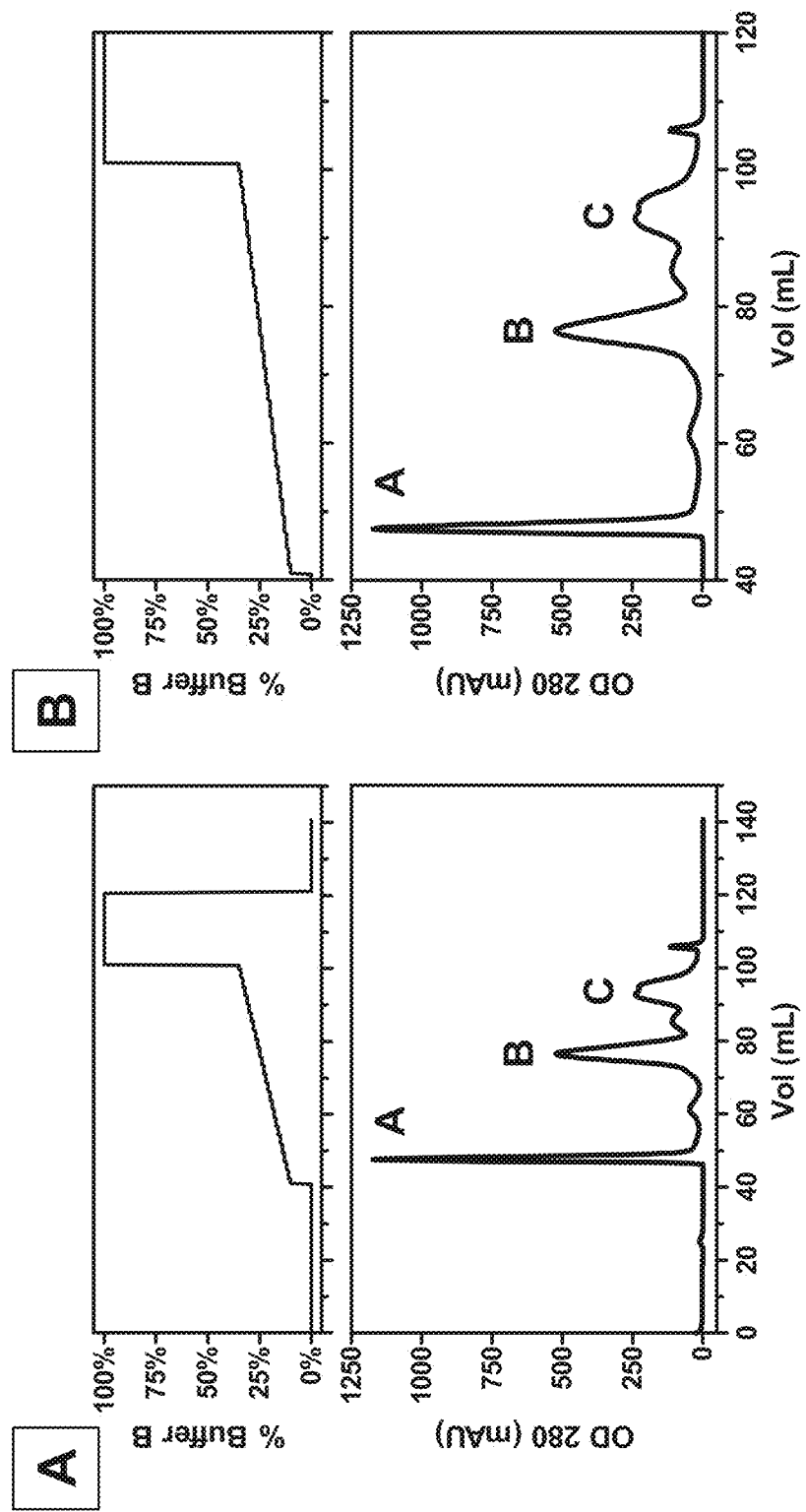

FIG. 81. Chromatogram (panels A, B) and LONZA® IEF pH 3-10 gel plate (panel C) demonstrating purification of the desired XENP11355 heterodimer species (Peak and Lane B). Purification is performed on a HITRAP® SP HP cation exchange column (5 mL) using Buffer A=50 mM MES at pH 6.0 and Buffer B=50 mM MES at pH 6.0 plus 1 M NaCl. A linear gradient (10-35% Buffer B) was used to affect the desired elution in addition to equilibration (0% Buffer B) and high salt wash (100% Buffer B) steps.

Figure 82:
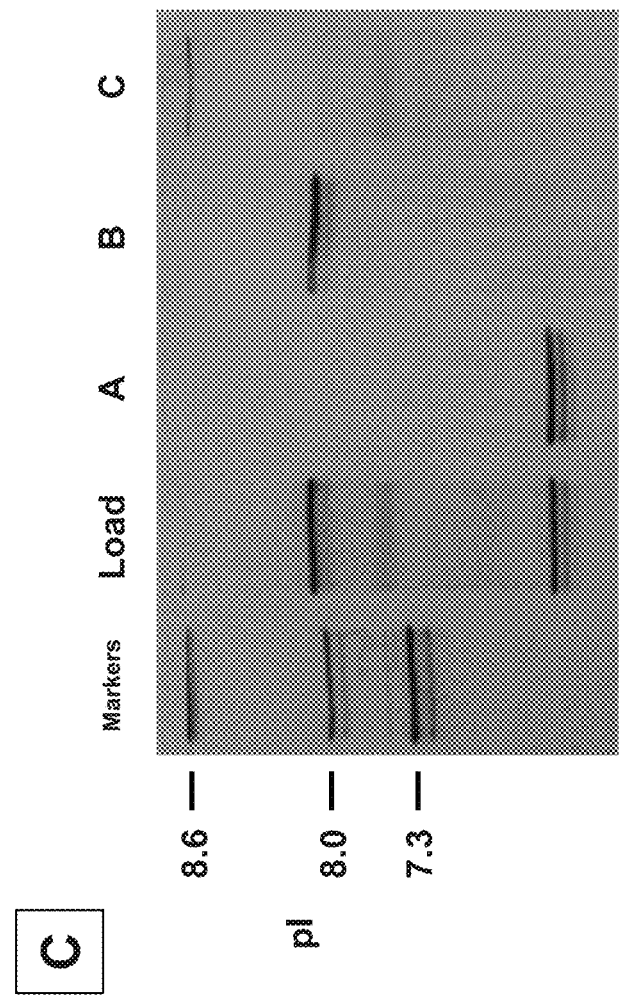

FIG. 82. [SEQ ID NOS: 140-141] Structure and sequences of XENP11139, a pI-engineered heterodimeric immunoglobulin variant, specifically an anti-CD19 x anti-CD32b dual scFv-Fc. The calculated pI values of desired heterodimeric and contaminating homodimeric species are listed. Domains that are pI-engineered are filled with solid white (ISO(−)) or solid black (ISO(+)).

Figure 83:
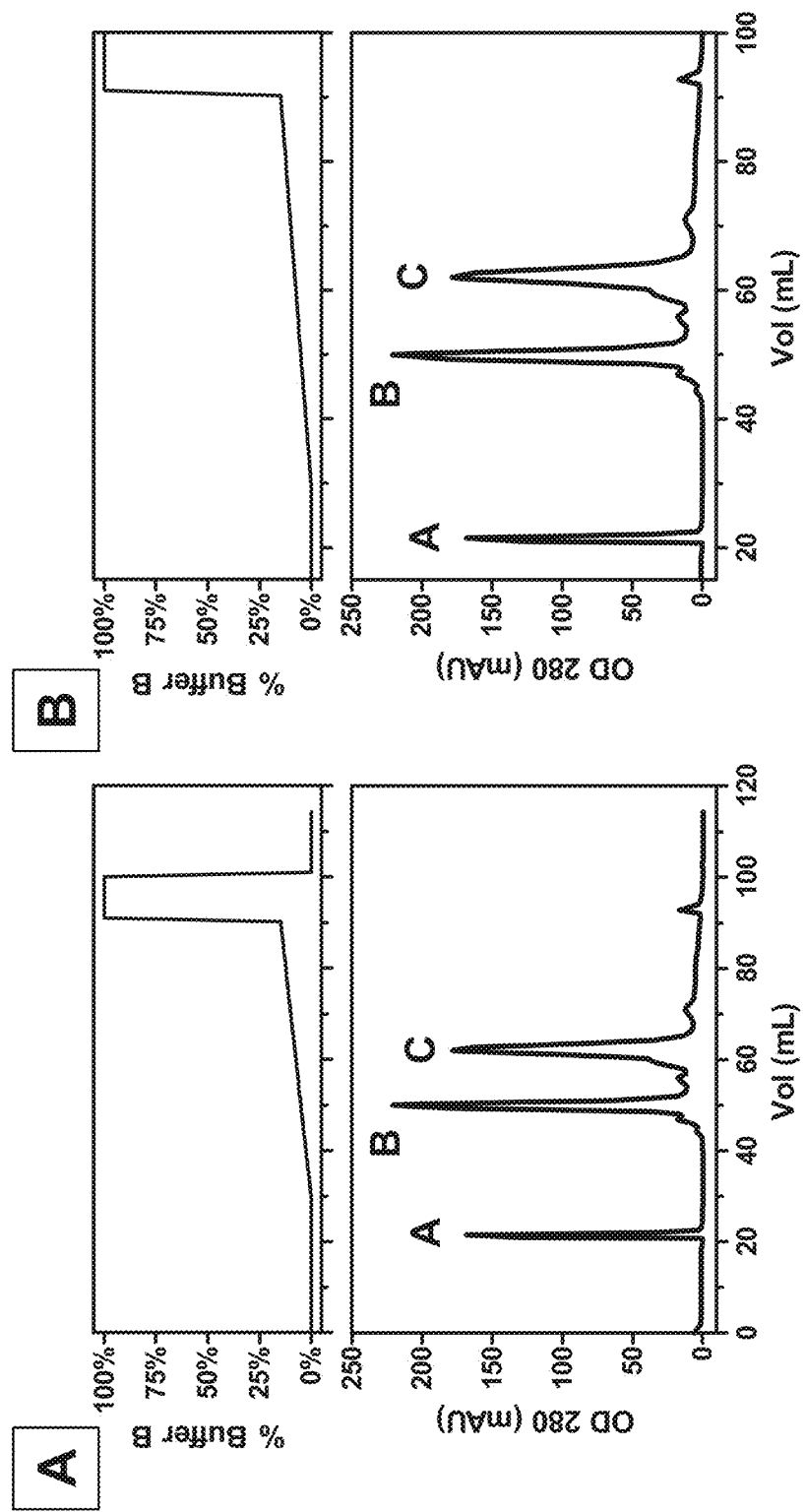
Figure 83:
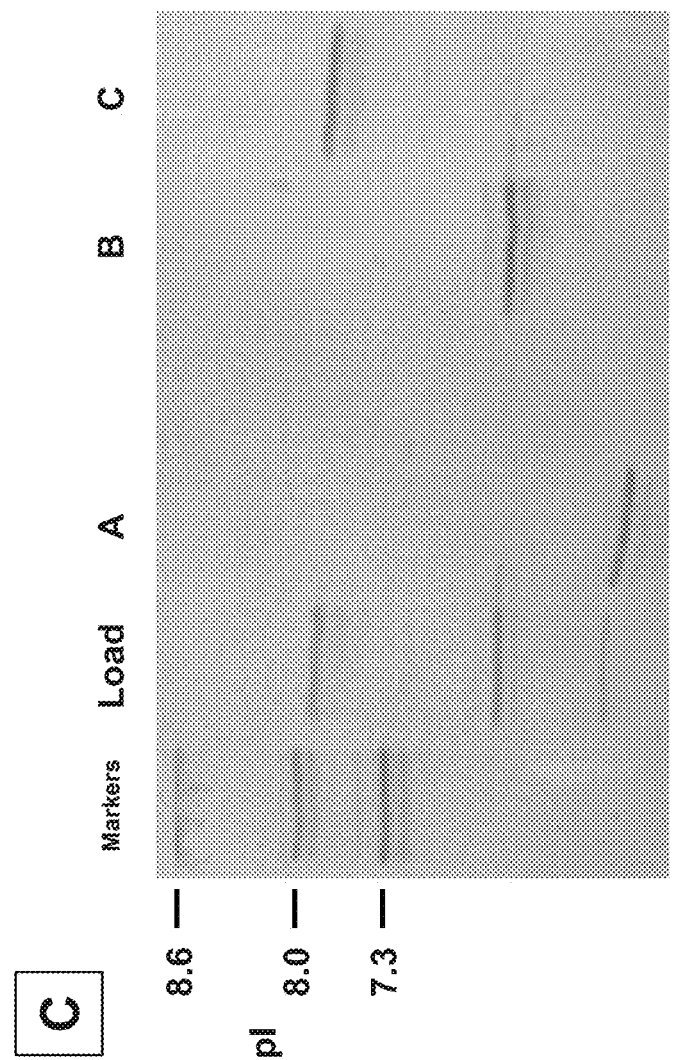

FIG. 83. Chromatogram (panels A, B) and LONZA® IEF pH 3-10 gel plate (panel C) demonstrating purification of the desired XENP11139 heterodimer species (Peak and Lane B). Purification is performed on a HITRAP® SP HP cation exchange column (1 mL) using Buffer A=50 mM MES at pH 6.0 and Buffer B=50 mM MES at pH 6.0 plus 1 M NaCl. A linear gradient (0-15% Buffer B) was used to affect the desired elution in addition to equilibration (0% Buffer B) and high salt wash (100% Buffer B) steps.

FIG. 84. [SEQ ID NOS: 142-143] Structure and sequences of XENP11338, a pI-engineered heterodimeric immunoglobulin variant, specifically an anti-CD19 x anti-CD3 dual scFv-Fc. The calculated pI values of desired heterodimeric and contaminating homodimeric species are listed. Domains that are pI-engineered are filled with solid white (ISO(−)) or solid black (ISO(+)).

Figure 85:
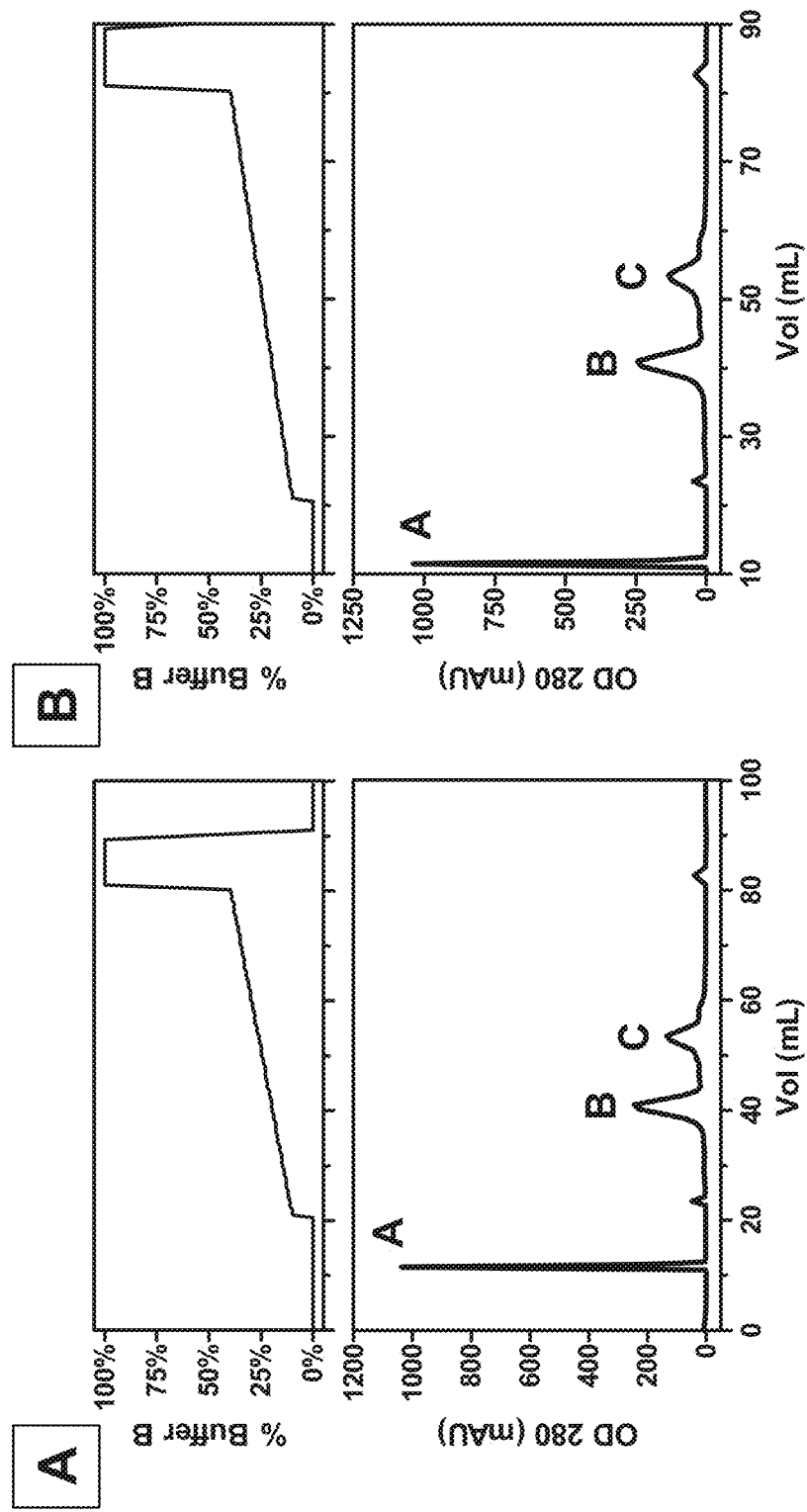
Figure 85:
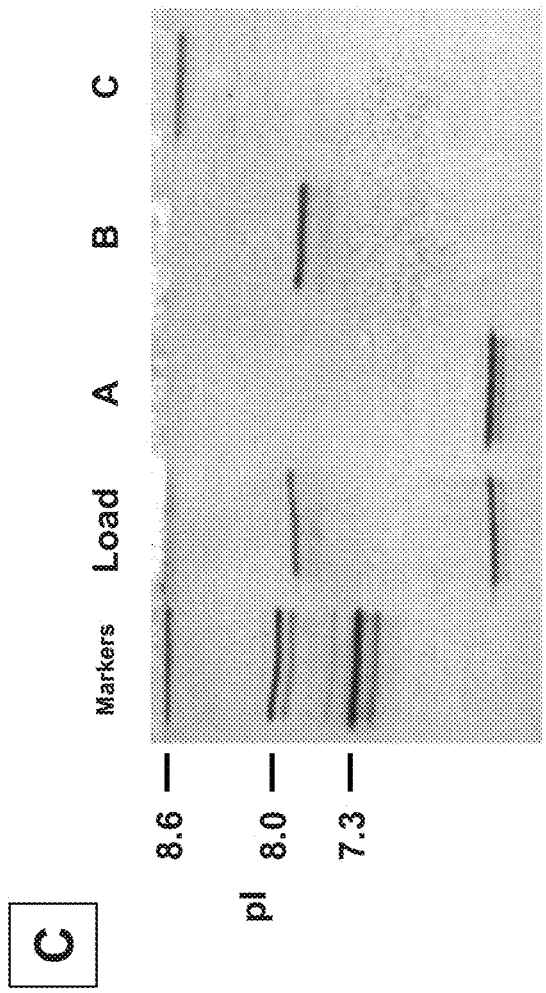

FIG. 85. Chromatogram (panels A, B) and LONZA® IEF pH 3-10 gel plate (panel C) demonstrating purification of the desired XENP11338 heterodimer species (Peak and Lane B). Purification is performed on a HITRAP® SP HP cation exchange column (1 mL) using Buffer A=50 mM MES at pH 6.0 and Buffer B=50 mM MES at pH 6.0 plus 1 M NaCl. A linear gradient (10-40% Buffer B) was used to affect the desired elution in addition to equilibration (0% Buffer B) and high salt wash (100% Buffer B) steps.

FIG. 86. [SEQ ID NOS: 144-145] Structure and sequences of XENP11233, a pI-engineered heterodimeric immunoglobulin variant, specifically an anti-CD40 monovalent mAb. The calculated pI values of desired heterodimeric and contaminating homodimeric species are listed. Domains that are pI-engineered are filled with solid white (ISO(−)) or solid black (ISO(+)).

Figure 87:
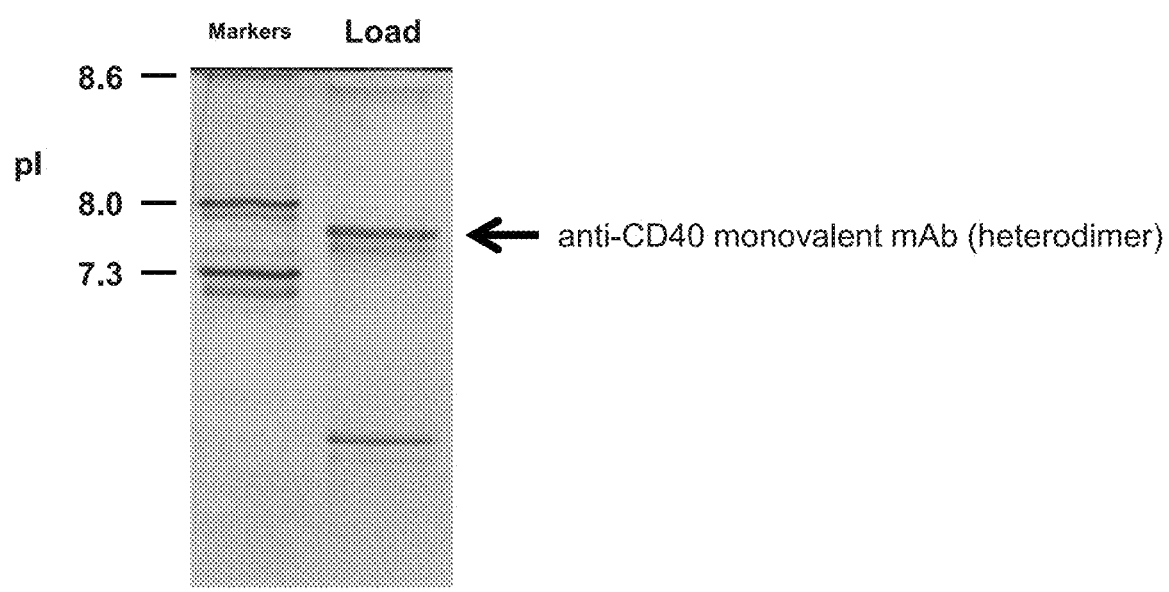

FIG. 87. LONZA® IEF pH 3-10 gel plate demonstrating the separation of the desired XENP11233 heterodimer species, which is denoted by an arrow.

FIG. 88. [SEQ ID NOS: 146-148] Structure and sequences of XENP11238, a pI-engineered heterodimeric immunoglobulin variant, specifically an anti-CD40 one-arm mAb. The calculated pI values of desired heterodimeric and contaminating homodimeric species are listed. Domains that are pI-engineered are filled with solid white (ISO(+)) or solid black (ISO(−)).

Figure 89:
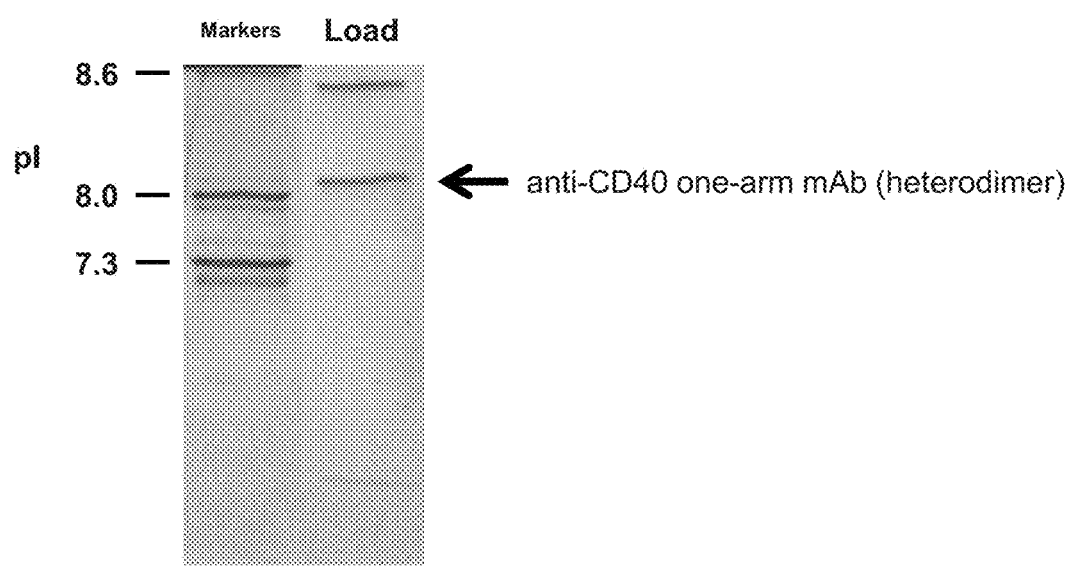

FIG. 89. LONZA® IEF pH 3-10 gel plate demonstrating the separation of the desired XENP11238 heterodimer species, which is denoted by an arrow.

FIG. 90. Data table of exemplary pI-engineered variants listing:

| | |
|---|---|
| XenP # | the internal reference number |
| Name (HC) | heavy chain sequence designation |
| SEQ ID NO (HC) | corresponding SEQ ID NO of the heavy chain sequence |
| Name (LC) | light chain sequence designation |
| SEQ ID NO (LC) | corresponding SEQ ID NO of the light chain sequence |
| Calc. pI | calculated pI value for the entire antibody sequence, including heavy and light chain Fv + constant domains, with the Fv of bevacizumab and the constant domains as defined in the table |
| # KR | number of Lys or Arg residues in IgG1 with the Fv of bevacizumab and the constant domains as defined in the table |
| Delta KR (vs. WT) | change in the number of Lys or Arg residues relative to IgG1 wild-type sequence of bevacizumab |
| # DE | number of Asp or Glu residues in IgG1 with the Fv of bevacizumab and the constant domains as defined in the table |
| Delta DE (vs. WT) | change in the number of Asp or Glu acid residues relative to IgG1 wild-type sequence of bevacizumab |
| Charge state | derived from the total number of Lys and Arg minus the total number of Asp and Glu residues, assuming a pH of 7 |
| # HC Mutations vs IgG1 | number of mutations in the heavy chain constant domain as compared to IgG1 |
| # LC Mutations vs IgG1 | number of mutations in the light chain constant domain as compared to IgG1 |
| Total # of Mutations | total number of mutations in the heavy chain and light chain constant domains as compared to IgG1 |

FIG. 91. Correlation of identifier names, protein names, and HC and LC names.

FIG. 92. [SEQ ID NOS: 149-276] Sequences of HC pI variants of FIG. 89.

FIG. 93. [SEQ ID NOS. 277-401] Sequences of LC pI variants of FIG. 89.

DETAILED DESCRIPTION OF THE INVENTION

I. Overview

An ongoing problem in antibody technologies is the desire for "bispecific" antibodies that bind to two different antigens simultaneously, in general thus allowing the different antigens to be brought into proximity and resulting in new functionalities and new therapies. In general, these antibodies are made by including genes for each heavy and light chain into the host cells. This generally results in the formation of the desired heterodimer (A-B), as well as the two homodimers (A-A and B-B). However, a major obstacle in the formation of multispecific antibodies is the difficulty in purifying the heterodimeric antibodies away from the homodimeric antibodies.

The present invention is generally directed to the creation of multispecific heterodimeric proteins, including heterodimeric antibodies and heterodimeric fusion proteins. Each protein of the dimer contains all or part of a variant constant heavy region of an antibody, as well as a fusion partner, discussed below. As is known in the art, two constant heavy chain regions will associate and form a dimer of heavy chains. In general, the ability to form heterodimers is a function of engineering amino acid variants into the constant heavy region of each protein of the dimer (A and B) such that the heterodimers (A-B) can be easily purified from the homodimers (A-A and B-B). This is generally done as outlined herein using amino acid changes that alter the pI of each protein of the dimer away from each other, thus allowing separation of heterodimers and homodimers using the different pIs of the protein (e.g. on ion exchange columns or gels). As will be outlined below, these variants can be introduced into one or both of the monomer polypeptides; that is, the pI of one of the monomers (referred to herein for simplicity as "monomer A") can be engineered away from monomer B, or both monomer A and B change be changed, with the pI of monomer A increasing and the pI of monomer B decreasing. Similarly, the pI changes of either or both monomers can be done by removing or adding a charged residue (e.g. a neutral amino acid is replaced by a positively or negatively charged amino acid residue, e.g. glycine to glutamic acid), changing a charged residue from positive or negative to the opposite charge (aspartic acid to lysine) or changing a charged residue to a neutral residue (e.g. loss of a charge; lysine to serine).

Accordingly, the present invention provides for creating a sufficient change in pI in at least one of the monomers such that heterodimers can be separated from homodimers. As will be appreciated by those in the art, and as discussed further below, this can be done by using a "wild type" heavy chain constant region and a variant region that has been engineered to either increase or decrease it's pI (wt A−+B or wt A−−B), or by increasing one region and decreasing the other region (A+−B−).

Thus, in general, the present invention is directed to altering the isoelectric point (pI) of at least one, if not both, of the monomers of a dimeric protein to form "pI heterodimers" (when the protein is an antibody, these are referred as "pI antibodies") by incorporating amino acid substitutions ("pI variants" or "pI substitutions") into one or both of the monomers. As shown herein, the separation of the heterodimers from the two homodimers can be accomplished if the pIs of the two monomers differ by as little as 0.1 pH unit, with 0.2, 0.3, 0.4 and 0.5 or greater all finding use in the present invention.

By using the constant region of the heavy chain, a more modular approach to designing and purifying multispecific proteins, including antibodies, is provided.

In addition, many embodiments of the invention rely on the "importation" of lower pI amino acids at particular positions from one IgG isotype into another, thus reducing or eliminating the possibility of unwanted immunogenicity being introduced into the variants. That is, IgG1 is a common isotype for therapeutic antibodies for a variety of reasons, including high effector function. However, the heavy constant region of IgG1 has a higher pI than that of IgG2 (8.10 versus 7.31). By introducing IgG2 residues at particular positions into the IgG1 backbone, the pI of the resulting protein is lowered, and additionally exhibits longer serum half-life. For example, IgG1 has a glycine (pI 5.97) at position 137, and IgG2 has a glutamic acid (pI 3.22); importing the glutamic acid will affect the pI of the resulting protein. As is described below, a number of amino acid substitutions are generally required to significant affect the pI of the variant antibody. However, it should be noted as discussed below that even changes in IgG2 molecules allow for increased serum half-life. Thus, an additional problem to be solved is the elucidation of low pI constant domains with high human sequence content, e.g. the minimization or avoidance of non-human residues at any particular position.

A side benefit that can occur with this pI engineering is also the extension of serum half-life and increased FcRn binding. That is, as described in U.S. Ser. No. 13/194,904 (incorporated by reference in its entirety), lowering the pI of antibody constant domains (including those found in antibodies and Fc fusions) can lead to longer serum retention in vivo. These pI variants for increased serum half life also facilitate pI changes for purification. Thus, in some embodiments, pI half life variants that increase serum half life also contribute to the ability to separate the heavy chains during purification. These pI half life variants are included in the definition of "pI variants" as discussed below, and can be used with any pI variant, as well as the "knobs and holes" sets of variants as described below.

In addition to amino acid changes that alter pI, previous work that relies on amino acid engineering that creates steric influences to favor heterodimeric formation and disfavor homodimeric formation can also optionally be used; this is sometimes referred to as "knobs and holes". Again, "knobs and holes" variants can optionally and independently be combined with pI variants, including pI half life variants.

In addition, as described below, additional amino acid substitutions for other functionalities may be included in the pI antibodies of the invention, such as Fc variants that alter binding to Fc receptors, amino acid substitutions made for affinity maturation, etc.

In addition to all or part of a variant heavy constant domain, one or both of the monomers may contain one or two fusion partners, such that the heterodimers form multivalent proteins. As is generally depicted the Figures, the fusion partners are depicted as A, B, C and D, with all combinations possible. In general, A, B, C and D are selected such that the heterodimer is at least bispecific or bivalent in its ability to interact with additional proteins.

As will be appreciated by those in the art and discussed more fully below, the heterodimeric fusion proteins of the present invention can take on a wide variety of configurations, as are generally depicted in the Figures. Some figures depict "single ended" configurations, where there is one type of specificity on one "arm" of the molecule and a different specificity on the other "arm". Other figures depict "dual ended" configurations, where there is at least one type of specificity at the "top" of the molecule and one or more different specificities at the "bottom" of the molecule. Furthermore as is shown, these two configurations can be combined, where there can be triple or quadruple specificities based on the particular combination. Thus, the present invention provides "multispecific" binding proteins, including multispecific antibodies.

II. Description of the Invention

Described herein are several definitions. Such definitions are meant to encompass grammatical equivalents.

By "ADCC" or "antibody dependent cell-mediated cytotoxicity" as used herein is meant the cell-mediated reaction wherein nonspecific cytotoxic cells that express FcγRs recognize bound antibody on a target cell and subsequently cause lysis of the target cell.

By "ADCP" or antibody dependent cell-mediated phagocytosis as used herein is meant the cell-mediated reaction wherein nonspecific cytotoxic cells that express FcγRs recognize bound antibody on a target cell and subsequently cause phagocytosis of the target cell.

By "amino acid" and "amino acid identity" as used herein is meant one of the 20 naturally occurring amino acids or any non-natural analogues that may be present at a specific, defined position.

By "CDC" or "complement dependent cytotoxicity" as used herein is meant the reaction wherein one or more complement protein components recognize bound antibody on a target cell and subsequently cause lysis of the target cell.

By "effector function" as used herein is meant a biochemical event that results from the interaction of an antibody Fc region with an Fc receptor or ligand. Effector functions include FcγR-mediated effector functions such as ADCC and ADCP, and complement-mediated effector functions such as CDC. Further, effector functions include FcγRIIb-mediated effector functions, such as inhibitory functions (e.g., downregulating, reducing, inhibiting etc., B cell responses, e.g., a humoral immune response).

By "effector cell" as used herein is meant a cell of the immune system that expresses one or more Fc and/or complement receptors and mediates one or more effector functions. Effector cells include but are not limited to monocytes, macrophages, neutrophils, dendritic cells, eosinophils, mast cells, platelets, B cells, large granular lymphocytes, Langerhans' cells, natural killer (NK) cells, and γ.delta. T cells, and may be from any organism including but not limited to humans, mice, rats, rabbits, and monkeys.

By "Fab" or "Fab region" as used herein is meant the polypeptides that comprise the V.sub.H, CH1, V.sub.H, and C.sub.L immunoglobulin domains. Fab may refer to this region in isolation, or this region in the context of a full length antibody or antibody fragment.

By "Fc" or "Fc region" or "Fc domain", as used herein is meant the polypeptide comprising the constant region of an antibody excluding the first constant region immunoglobulin domain and in some cases, part of the hinge. Thus Fc refers to the last two constant region immunoglobulin domains of IgA, IgD, and IgG, and the last three constant region immunoglobulin domains of IgE and IgM, and the flexible hinge N-terminal to these domains. For IgA and IgM, Fc may include the J chain. For IgG, Fc comprises immunoglobulin domains Cgamma2 and Cgamma3 (Cγ2 and Cγ3) and the hinge between Cgamma1 (Cγ1) and Cgamma2 (Cγ2). Although the boundaries of the Fc region may vary, the human IgG heavy chain Fc region is usually defined to comprise residues C226 or P230 to its carboxyl-terminus, wherein the numbering is according to the EU index as in Kabat. Fc may refer to this region in isolation, or this region in the context of an Fc polypeptide, as described below.

By "Fc polypeptide" as used herein is meant a polypeptide that comprises all or part of an Fc region. Fc polypeptides include antibodies, Fc fusions, isolated Fcs, and Fc fragments. Immunoglobulins may be Fc polypeptides.

By "Fc fusion" as used herein is meant a protein wherein one or more polypeptides is operably linked to an Fc domain, particularly a variant Fc domain. Fc fusion is herein meant to be synonymous with the terms "immunoadhesin", "Ig fusion", "Ig chimera", and "receptor globulin" (sometimes with dashes) as used in the prior art (Chamow et al., 1996, Trends Biotechnol 14:52-60; Ashkenazi et al., 1997, Curr Opin Immunol 9:195-200, both hereby entirely incorporated by reference). An Fc fusion combines the Fc region of an immunoglobulin with a fusion partner, which in general may be any protein, polypeptide or small molecule. The role of the non-Fc part (in most cases for this invention, the pI domain) of an Fc fusion, i.e., the fusion partner, is to mediate target binding, and thus it is functionally analogous to the variable regions of an antibody. Virtually any protein or small molecule may be linked to Fc to generate an Fc fusion. Protein fusion partners may include, but are not limited to, the target-binding region of a receptor, an adhesion molecule, a ligand, an enzyme, a cytokine, a chemokine, or some other protein or protein domain. Small molecule fusion partners may include any therapeutic agent that directs the Fc fusion to a therapeutic target. Such targets may be any molecule, e.g., an extracellular receptor that is implicated in disease.

By "Fc gamma receptor" or "FcγR" as used herein is meant any member of the family of proteins that bind the IgG antibody Fc region and are substantially encoded by the FcγR genes. In humans this family includes but is not limited to FcγRI (CD64), including isoforms FcγRIa, FcγRIb, and FcγRIc; FcγRII (CD32), including isoforms FcγRIIa (including allotypes H131 and R131), FcγRIIb (including FcγRIIb-1 and FcγRIIb-2), and FcγRIIc; and FcγRIII (CD16), including isoforms FcγRIIIa (including allotypes V158 and F158) and FcγRIIIb (including allotypes FcγRIIIb-NA1 and FcγRIIIb-NA2) (Jefferis et al., 2002, Immunol Lett 82:57-65, incorporated entirely by reference), as well as any undiscovered human FcγRs or FcγR isoforms or allotypes. An FcγR may be from any organism, including but not limited to humans, mice, rats, rabbits, and monkeys. Mouse FcγRs include but are not limited to FcγRI (CD64), FcγRII (CD32), FcγRIII (CD16), and FcγRIII-2 (CD16-2), as well as any undiscovered mouse FcγRs or FcγR isoforms or allotypes.

By "Fc ligand" or "Fc receptor" as used herein is meant a molecule, e.g., a polypeptide, from any organism that binds to the Fc region of an antibody to form an Fc-ligand complex. Fc ligands include but are not limited to FcγRs, FcγRs, FcγRs, FcRn, Cq, C3, mannan binding lectin, mannose receptor, staphylococcal protein A, streptococcal protein G, and viral FcγR. Fc ligands also include Fc receptor homologs (FcRH), which are a family of Fc receptors that are homologous to the FcγRs (Davis et al., 2002, Immunological Reviews 190:123-136). Fc ligands may include undiscovered molecules that bind Fc.

By "modification" herein is meant an alteration in the physical, chemical, or sequence properties of a protein, polypeptide, antibody, or immunoglobulin. Modifications described herein include amino acid modifications and glycoform modifications.

By "amino acid modification" herein is meant an amino acid substitution, insertion, and/or deletion in a polypeptide sequence. By "amino acid substitution" or "substitution" herein is meant the replacement of an amino acid at a particular position in a parent polypeptide sequence with another, different amino acid. For clarity, an "amino acid substitution" requires a different amino acid than the parent amino acid at the substituted position. For example, the substitution S267E refers to a variant polypeptide, in this case a constant heavy chain variant, in which the serine at position 267 is replaced with glutamic acid. By "amino acid insertion" or "insertion" as used herein is meant the addition of an amino acid at a particular position in a parent polypeptide sequence. By "amino acid deletion" or "deletion" as used herein is meant the removal of an amino acid at a particular position in a parent polypeptide sequence.

By "glycoform modification" or "modified glycoform" or "engineered glycoform" as used herein is meant a carbohydrate composition that is covalently attached to a protein, for example an antibody, wherein said carbohydrate composition differs chemically from that of a parent protein. Modified glycoform typically refers to the different carbohydrate or oligosaccharide; thus for example an Fc variant may comprise a modified glycoform. Alternatively, modified glycoform may refer to the Fc variant that comprises the different carbohydrate or oligosaccharide.

By "parent polypeptide", "parent protein", "parent immunogloblin", "precursor polypeptide", "precursor protein", or "precursor immunoglobulin" as used herein is meant an unmodified polypeptide, protein, or immunoglobulin that is subsequently modified to generate a variant, e.g., any polypeptide, protein or immunoglobulin which serves as a template and/or basis for at least one amino acid modification described herein. The parent polypeptide may be a naturally occurring polypeptide, or a variant or engineered version of a naturally occurring polypeptide. Parent polypeptide may refer to the polypeptide itself, compositions that comprise the parent polypeptide, or the amino acid sequence that encodes it. Accordingly, by "parent Fc polypeptide" as used herein is meant an Fc polypeptide that is modified to generate a variant Fc polypeptide, and by "parent antibody" as used herein is meant an antibody that is modified to generate a variant antibody (e.g., a parent antibody may include, but is not limited to, a protein comprising the constant region of a naturally occurring Ig).

By "position" as used herein is meant a location in the sequence of a protein. Positions may be numbered sequentially, or according to an established format, for example the EU index as in Kabat. For example, position 297 is a position in the human antibody IgG1.

By "polypeptide" or "protein" as used herein is meant at least two covalently attached amino acids, which includes proteins, polypeptides, oligopeptides and peptides.

By "residue" as used herein is meant a position in a protein and its associated amino acid identity. For example, Asparagine 297 (also referred to as Asn297, also referred to as N297) is a residue in the human antibody IgG1.

By "target antigen" as used herein is meant the molecule that is bound by the variable region of a given antibody, or the fusion partner of an Fc fusion. A target antigen may be a protein, carbohydrate, lipid, or other chemical compound. An antibody or Fc fusion is said to be "specific" for a given target antigen based on having affinity for the target antigen. A variety of target antigens are listed below.

By "target cell" as used herein is meant a cell that expresses a target antigen.

By "variable region" as used herein is meant the region of an immunoglobulin that comprises one or more Ig domains substantially encoded by any of the V.kappa., V.lamda., and/or VH genes that make up the kappa, lambda, and heavy chain immunoglobulin genetic loci respectively.

By "variant polypeptide", "polypeptide variant", or "variant" as used herein is meant a polypeptide sequence that differs from that of a parent polypeptide sequence by virtue of at least one amino acid modification. The parent polypeptide may be a naturally occurring or wild-type (WT) polypeptide, or may be a modified version of a WT polypeptide. Variant polypeptide may refer to the polypeptide itself, a composition comprising the polypeptide, or the amino sequence that encodes it. In some embodiments, variant polypeptides disclosed herein (e.g., variant immunoglobulins) may have at least one amino acid modification compared to the parent polypeptide, e.g. from about one to about ten amino acid modifications, from about one to about five amino acid modifications, etc. compared to the parent. The variant polypeptide sequence herein may possess at least about 80% homology with a parent polypeptide sequence, e.g., at least about 90% homology, 95% homology, etc. Accordingly, by "Fc variant" or "variant Fc" as used herein is meant an Fc sequence that differs from that of a parent Fc sequence by virtue of at least one amino acid modification. An Fc variant may only encompass an Fc region, or may exist in the context of an antibody, Fc fusion, isolated Fc, Fc fragment, or other polypeptide that is substantially encoded by Fc. Fc variant may refer to the Fc polypeptide itself, compositions comprising the Fc variant polypeptide, or the amino acid sequence that encodes it. By "Fc polypeptide variant" or "variant Fc polypeptide" as used herein is meant an Fc polypeptide that differs from a parent Fc polypeptide by virtue of at least one amino acid modification. By "protein variant" or "variant protein" as used herein is meant a protein that differs from a parent protein by virtue of at least one amino acid modification. By "antibody variant" or "variant antibody" as used herein is meant an antibody that differs from a parent antibody by virtue of at least one amino acid modification. By "IgG variant" or "variant IgG" as used herein is meant an antibody that differs from a parent IgG by virtue of at least one amino acid modification. By "immunoglobulin variant" or "variant immunoglobulin" as used herein is meant an immunoglobulin sequence that differs from that of a parent immunoglobulin sequence by virtue of at least one amino acid modification.

By "wild type" or "WT" herein is meant an amino acid sequence or a nucleotide sequence that is found in nature, including allelic variations. A WT protein, polypeptide, antibody, immunoglobulin, IgG, etc. has an amino acid sequence or a nucleotide sequence that has not been intentionally modified.

B. Antibodies

The present invention relates to the generation of pI variants of antibodies, generally therapeutic antibodies. As is discussed below, the term "antibody" is used generally. Antibodies that find use in the present invention can take on a number of formats as described herein, including traditional antibodies as well as antibody derivatives, fragments and mimetics, described below. In general, the term "antibody" for the purposes of this invention includes any polypeptide that includes at least one constant domain, including, but not limited to, CH1, CH2, CH3 and CL. That is, the pI engineering of constant regions can be used with "traditional" antibody technologies, such as variable regions, to form multispecific antibodies, or the technology can be used with fusion partners to make bispecific binding proteins. Unless otherwise stated, "antibody" includes the use of pI engineered constant regions to make multispecific proteins, including fusion partners comprising variable regions.

In general, the specification references "heavy chain constant domains", which comprise CH1-hinge-CH2-CH3 components (e.g. without the heavy chain variable domain), also sometimes referred to as "CH1-Fc domains". However, in some cases, the pI variants are made using just the Fc region.

Traditional antibody structural units typically comprise a tetramer. Each tetramer is typically composed of two identical pairs of polypeptide chains, each pair having one "light" (typically having a molecular weight of about 25 kDa) and one "heavy" chain (typically having a molecular weight of about 50-70 kDa). Human light chains are classified as kappa and lambda light chains. The present invention is directed to the IgG class, which has several subclasses, including, but not limited to IgG1, IgG2, IgG3, and IgG4. Thus, "isotype" as used herein is meant any of the subclasses of immunoglobulins defined by the chemical and antigenic characteristics of their constant regions. It should be understood that therapeutic antibodies can also comprise hybrids of isotypes and/or subclasses. For example, as shown herein, the present invention covers pI engineering of IgG1/G2 hybrids.

The amino-terminal portion of each chain includes a variable region of about 100 to 110 or more amino acids primarily responsible for antigen recognition, generally referred to in the art and herein as the "Fv domain" or "Fv region". In the variable region, three loops are gathered for each of the V domains of the heavy chain and light chain to form an antigen-binding site. Each of the loops is referred to as a complementarity-determining region (hereinafter referred to as a "CDR"), in which the variation in the amino acid sequence is most significant. "Variable" refers to the fact that certain segments of the variable region differ extensively in sequence among antibodies. Variability within the variable region is not evenly distributed. Instead, the V regions consist of relatively invariant stretches called framework regions (FRs) of 15-30 amino acids separated by shorter regions of extreme variability called "hypervariable regions" that are each 9-15 amino acids long or longer.

In some embodiments, the pI engineered constant regions can be joined to single chain Fv ("scFv") regions, such that the heteroproteins of the invention comprise a first pI engineered constant chain with a first scFv with binding specificity to a first antigen, and a second pI engineered constant chain with a second scFv with binding specificity to a second antigen. Alternative formats are also found in the Figures and described herein.

Each VH and VL is composed of three hypervariable regions ("complementary determining regions," "CDRs") and four FRs, arranged from amino-terminus to carboxy-terminus in the following order: FR1-CDR1-FR2-CDR2-FR3-CDR3-FR4.

The hypervariable region generally encompasses amino acid residues from about amino acid residues 24-34 (LCDR1; "L" denotes light chain), 50-56 (LCDR2) and 89-97 (LCDR3) in the light chain variable region and around about 31-35B (HCDR1; "H" denotes heavy chain), 50-65 (HCDR2), and 95-102 (HCDR3) in the heavy chain variable region; Kabat et al., SEQUENCES OF PROTEINS OF IMMUNOLOGICAL INTEREST, 5 Ed. Public Health Service, National Institutes of Health, Bethesda, Md. (1991) and/or those residues forming a hypervariable loop (e.g. residues 26-32 (LCDR1), 50-52 (LCDR2) and 91-96 (LCDR3) in the light chain variable region and 26-32 (HCDR1), 53-55 (HCDR2) and 96-101 (HCDR3) in the heavy chain variable region; Chothia and Lesk (1987) J. Mol. Biol. 196:901-917. Specific CDRs of the invention are described below.

Throughout the present specification, the Kabat numbering system is generally used when referring to a residue in the variable domain (approximately, residues 1-107 of the light chain variable region and residues 1-113 of the heavy chain variable region) (e.g, Kabat et al., supra (1991)).

The CDRs contribute to the formation of the antigen-binding, or more specifically, epitope binding site of antibodies. "Epitope" refers to a determinant that interacts with a specific antigen binding site in the variable region of an antibody molecule known as a paratope. Epitopes are groupings of molecules such as amino acids or sugar side chains and usually have specific structural characteristics, as well as specific charge characteristics. A single antigen may have more than one epitope.

The epitope may comprise amino acid residues directly involved in the binding (also called immunodominant component of the epitope) and other amino acid residues, which are not directly involved in the binding, such as amino acid residues which are effectively blocked by the specifically antigen binding peptide; in other words, the amino acid residue is within the footprint of the specifically antigen binding peptide.

Epitopes may be either conformational or linear. A conformational epitope is produced by spatially juxtaposed amino acids from different segments of the linear polypeptide chain. A linear epitope is one produced by adjacent amino acid residues in a polypeptide chain. Conformational and nonconformational epitopes may be distinguished in that the binding to the former but not the latter is lost in the presence of denaturing solvents.

An epitope typically includes at least 3, and more usually, at least 5 or 8-10 amino acids in a unique spatial conformation. Antibodies that recognize the same epitope can be verified in a simple immunoassay showing the ability of one antibody to block the binding of another antibody to a target antigen, for example "binning."

The carboxy-terminal portion of each chain defines a constant region primarily responsible for effector function. Kabat et al. collected numerous primary sequences of the variable regions of heavy chains and light chains. Based on the degree of conservation of the sequences, they classified individual primary sequences into the CDR and the framework and made a list thereof (see SEQUENCES OF IMMUNOLOGICAL INTEREST, 5th edition, NIH publication, No. 91-3242, E. A. Kabat et al., entirely incorporated by reference).

In the IgG subclass of immunoglobulins, there are several immunoglobulin domains in the heavy chain. By "immunoglobulin (Ig) domain" herein is meant a region of an immunoglobulin having a distinct tertiary structure. Of interest in the present invention are the heavy chain domains, including, the constant heavy (CH) domains and the hinge domains. In the context of IgG antibodies, the IgG isotypes each have three CH regions. Accordingly, "CH" domains in the context of IgG are as follows: "CH1" refers to positions 118-220 according to the EU index as in Kabat. "CH2" refers to positions 237-340 according to the EU index as in Kabat, and "CH3" refers to positions 341-447 according to the EU index as in Kabat. As shown herein and described below, the pI variants can be in one or more of the CH regions, as well as the hinge region, discussed below.

It should be noted that the sequences depicted herein start at the CH1 region, position 118; the variable regions are not included except as noted. For example, the first amino acid of SEQ ID NO: 2, while designated as position "1" in the sequence listing, corresponds to position 118 of the CH1 region, according to EU numbering.

Another type of Ig domain of the heavy chain is the hinge region. By "hinge" or "hinge region" or "antibody hinge region" or "immunoglobulin hinge region" herein is meant the flexible polypeptide comprising the amino acids between the first and second constant domains of an antibody. Structurally, the IgG CH1 domain ends at EU position 220, and the IgG CH2 domain begins at residue EU position 237. Thus for IgG the antibody hinge is herein defined to include positions 221 (D221 in IgG1) to 236 (G236 in IgG1), wherein the numbering is according to the EU index as in Kabat. In some embodiments, for example in the context of an Fc region, the lower hinge is included, with the "lower hinge" generally referring to positions 226 or 230. As noted herein, pI variants can be made in the hinge region as well.

The light chain generally comprises two domains, the variable light domain (containing the light chain CDRs and together with the variable heavy domains forming the Fv region), and a constant light chain region (often referred to as CL or Cκ).

Another region of interest for additional substitutions, outlined below, is the Fc region. By "Fc" or "Fc region" or "Fc domain" as used herein is meant the polypeptide comprising the constant region of an antibody excluding the first constant region immunoglobulin domain and in some cases, part of the hinge. Thus Fc refers to the last two constant region immunoglobulin domains of IgA, IgD, and IgG, the last three constant region immunoglobulin domains of IgE and IgM, and the flexible hinge N-terminal to these domains. For IgA and IgM, Fc may include the J chain. For IgG, the Fc domain comprises immunoglobulin domains Cγ2 and Cγ3 (Cγ2 and Cγ3) and the lower hinge region between Cγ1 (Cγ1) and Cγ2 (Cγ2). Although the boundaries of the Fc region may vary, the human IgG heavy chain Fc region is usually defined to include residues C226 or P230 to its carboxyl-terminus, wherein the numbering is according to the EU index as in Kabat. In some embodiments, as is more fully described below, amino acid modifications are made to the Fc region, for example to alter binding to one or more FcγR receptors or to the FcRn receptor.

In some embodiments, the antibodies are full length. By "full length antibody" herein is meant the structure that constitutes the natural biological form of an antibody, including variable and constant regions, including one or more modifications as outlined herein.

Alternatively, the antibodies can be a variety of structures, including, but not limited to, antibody fragments, monoclonal antibodies, multispecific antibodies (as described herein, which include bi-, tri- and quadraspecific antibodies), minibodies, domain antibodies, synthetic antibodies (sometimes referred to herein as "antibody mimetics"), chimeric antibodies, humanized antibodies, antibody fusions (sometimes referred to as "antibody conjugates"), and fragments of each, respectively.

In one embodiment, the antibody is an antibody fragment, as long as it contains at least one constant domain which can be pI engineered. Specific antibody fragments include, but are not limited to, (i) the Fab fragment consisting of VL, VH, CL and CH1 domains, (ii) the Fd fragment consisting of the VH and CH1 domains, (iii) F(ab')2 fragments, a bivalent fragment comprising two linked Fab fragments (vii) single chain Fv molecules (scFv), wherein a VH domain and a VL domain are linked by a peptide linker which allows the two domains to associate to form an antigen binding site (Bird et al., 1988, Science 242:423-426, Huston et al., 1988, Proc. Natl. Acad. Sci. U.S.A. 85:5879-5883, entirely incorporated by reference), (iv) "diabodies" or "triabodies", multivalent or multispecific fragments constructed by gene fusion (Tomlinson et. al., 2000, Methods Enzymol. 326:461-479; WO94/13804; Holliger et al., 1993, Proc. Natl. Acad. Sci. U.S.A. 90:6444-6448, all entirely incorporated by reference).

Other antibody fragments that can be used include fragments that contain one or more of the CH1, CH2, CH3, hinge and CL domains of the invention that have been pI engineered. For example, Fc fusions are fusions of the Fc region (CH2 and CH3, optionally with the hinge region) fused to another protein. A number of Fc fusions are known the art and can be improved by the addition of the pI variants of the invention. In the present case, antibody fusions can be made comprising CH1; CH1, CH2 and CH3; CH2; CH3; CH2 and CH3; CH1 and CH3, any or all of which can be made optionally with the hinge region, utilizing any combination of pI variants described herein.

B. Chimeric and Humanized Antibodies

In some embodiments, the antibody can be a mixture from different species, e.g. a chimeric antibody and/or a humanized antibody. In general, both "chimeric antibodies" and "humanized antibodies" refer to antibodies that combine regions from more than one species. For example, "chimeric antibodies" traditionally comprise variable region(s) from a mouse (or rat, in some cases) and the constant region(s) from a human. "Humanized antibodies" generally refer to non-human antibodies that have had the variable-domain framework regions swapped for sequences found in human antibodies. Generally, in a humanized antibody, the entire antibody, except the CDRs, is encoded by a polynucleotide of human origin or is identical to such an antibody except within its CDRs. The CDRs, some or all of which are encoded by nucleic acids originating in a non-human organism, are grafted into the beta-sheet framework of a human antibody variable region to create an antibody, the specificity of which is determined by the engrafted CDRs. The creation of such antibodies is described in, e.g., WO 92/11018, Jones, 1986, Nature 321:522-525, Verhoeyen et al., 1988, Science 239:1534-1536, all entirely incorporated by reference. "Backmutation" of selected acceptor framework residues to the corresponding donor residues is often required to regain affinity that is lost in the initial grafted construct (U.S. Pat. Nos. 5,530,101; 5,585,089; 5,693,761; 5,693,762; 6,180,370; 5,859,205; 5,821,337; 6,054,297; 6,407,213, all entirely incorporated by reference). The humanized antibody optimally also will comprise at least a portion of an immunoglobulin constant region, typically that of a human immunoglobulin, and thus will typically comprise a human Fc region. Humanized antibodies can also be generated using mice with a genetically engineered immune system. Roque et al., 2004, Biotechnol. Prog. 20:639-654, entirely incorporated by reference. A variety of techniques and methods for humanizing and reshaping non-human antibodies are well known in the art (See Tsurushita & Vasquez, 2004, Humanization of Monoclonal Antibodies, Molecular Biology of B Cells, 533-545, Elsevier Science (USA), and references cited therein, all entirely incorporated by reference). Humanization methods include but are not limited to methods described in Jones et al., 1986, Nature 321:522-525; Riechmann et al., 1988; Nature 332:323-329; Verhoeyen et al., 1988, Science, 239:1534-1536; Queen et al., 1989, Proc Natl Acad Sci, USA 86:10029-33; He et al., 1998, J. Immunol. 160: 1029-1035; Carter et al., 1992, Proc Natl Acad Sci USA 89:4285-9, Presta et al., 1997, Cancer Res. 57(20):4593-9; Gorman et al., 1991, Proc. Natl. Acad. Sci. USA 88:4181-4185; O'Connor et al., 1998, Protein Eng 11:321-8, all entirely incorporated by reference. Humanization or other methods of reducing the immunogenicity of nonhuman antibody variable regions may include resurfacing methods, as described for example in Roguska et al., 1994, Proc. Natl. Acad. Sci. USA 91:969-973, entirely incorporated by reference. In one embodiment, the parent antibody has been affinity matured, as is known in the art. Structure-based methods may be employed for humanization and affinity maturation, for example as described in U.S. Ser. No. 11/004,590. Selection based methods may be employed to humanize and/or affinity mature antibody variable regions, including but not limited to methods described in Wu et al., 1999, J. Mol. Biol. 294:151-162; Baca et al., 1997, J. Biol. Chem. 272(16):10678-10684; Rosok et al., 1996, J. Biol. Chem. 271(37): 22611-22618; Rader et al., 1998, Proc. Natl. Acad. Sci. USA 95: 8910-8915; Krauss et al., 2003, Protein Engineering 16(10):753-759, all entirely incorporated by reference. Other humanization methods may involve the grafting of only parts of the CDRs, including but not limited to methods described in U.S. Ser. No. 09/810,510; Tan et al., 2002, J. Immunol. 169:1119-1125; De Pascalis et al., 2002, J. Immunol. 169:3076-3084, all entirely incorporated by reference.

In one embodiment, the antibody is a minibody. Minibodies are minimized antibody-like proteins comprising a scFv joined to a CH3 domain. Hu et al., 1996, Cancer Res. 56:3055-3061, entirely incorporated by reference. In the present instance, the CH3 domain can be pI engineered. In some cases, the scFv can be joined to the Fc region, and may include some or the entire hinge region.

The antibodies of the present invention are generally isolated or recombinant. "Isolated," when used to describe the various polypeptides disclosed herein, means a polypeptide that has been identified and separated and/or recovered from a cell or cell culture from which it was expressed. Ordinarily, an isolated polypeptide will be prepared by at least one purification step. An "isolated antibody," refers to an antibody which is substantially free of other antibodies having different antigenic specificities.

"Specific binding" or "specifically binds to" or is "specific for" a particular antigen or an epitope means binding that is measurably different from a non-specific interaction. Specific binding can be measured, for example, by determining binding of a molecule compared to binding of a control molecule, which generally is a molecule of similar structure that does not have binding activity. For example, specific binding can be determined by competition with a control molecule that is similar to the target.

Specific binding for a particular antigen or an epitope can be exhibited, for example, by an antibody having a KD for an antigen or epitope of at least about $10^{-4}$ M, at least about $10^{-5}$ M, at least about $10^{-6}$ M, at least about $10^{-7}$ M, at least about $10^{-8}$ M, at least about $10^{-9}$ M, alternatively at least about $10^{-10}$ M, at least about $10^{-11}$ M, at least about $10^{-12}$ M, or greater, where KD refers to a dissociation rate of a particular antibody-antigen interaction. Typically, an antibody that specifically binds an antigen will have a KD that is 20-, 50-, 100-, 500-, 1000-, 5,000-, 10,000- or more times greater for a control molecule relative to the antigen or epitope.

Also, specific binding for a particular antigen or an epitope can be exhibited, for example, by an antibody having a KA or Ka for an antigen or epitope of at least 20-, 50-, 100-, 500-, 1000-, 5,000-, 10,000- or more times greater for the epitope relative to a control, where KA or Ka refers to an association rate of a particular antibody-antigen interaction.

C. pI Variants

Accordingly, the present invention provides heterodimeric proteins based on the use of monomers containing variant heavy chain constant regions as a first domain. By "monomer" herein is meant one half of the heterodimeric protein. It should be noted that antibodies are actually tetrameric (two heavy chains and two light chains). In the context of the present invention, one set of heavy-light chains is considered a "monomer". Similarly, a heavy chain constant region with a single chain Fv regions (scFv) is also considered a "monomer". In the case where an Fv region is one fusion partner (e.g. heavy and light chain) and a non-antibody protein is another fusion partner, each "half" is considered a monomer.

The variant heavy chain constant regions can comprise all or part of the heavy chain constant region, including the full length construct, CH1-hinge-CH2-CH3, or portions thereof, including for example CH2-CH3. In addition, the heavy chain region of each monomer can be the same backbone (CH1-hinge-CH2-CH3 or CH2-CH3) or different. N- and C-terminal truncations and additions are also included within the definition; for example, some pI variants include the addition of charged amino acids to the C-terminus of the heavy chain domain (e.g. (DE)n, where n can be 1, 2, 3, etc.).

Furthermore, in addition to the pI substitutions outlined herein, the heavy chain regions may also contain additional amino acid substitutions, including changes for altering Fc binding as discussed below.

In general, as will be appreciated by those in the art, there are two general categories of pI variants: those that increase the pI of the protein (basic changes) and those that decrease the pI of the protein (acidic changes). As described herein, all combinations of these variants can be done: one monomer may be wild type, or a variant that does not display a significantly different pI from wild-type, and the other can be either more basic or more acidic. Alternatively, each monomer is changed, one to more basic and one to more acidic.

In addition, some monomers can utilize linkers between the variant heavy chain constant region and the fusion partner as is more fully outlined below. Traditional peptide linkers can be used, including flexible linkers of glycine and serine. In some cases, the linkers for use as components of the monomer are different from those defined below for the ADC constructs, and are in many embodiments not cleavable linkers (such as those susceptible to proteases), although cleavable linkers may find use in some embodiments.

Accordingly, the present invention relates to the generation of pI variants of antibodies. "pI" refers to the isoelectric point of a molecule (including both the individual amino acids and antibodies) and is the pH at which a particular molecule or surface carries no net electrical charge. In addition, the invention herein sometimes refers to changes in the "charge state" of the proteins at pH 7. That is, wild-type heavy constant region of IgG1 has a charge state of +6, while the heavy constant region of IgG2 has a charge state of 0. Variant 9493 (with a SEQ ID NO: 193 heavy chain constant domain and a SEQ ID NO:117 light chain constant domain) has 12 substitutions in both the heavy and light constant regions resulting in a charge state of −30.

The present invention relates to the generation of pI variants of antibodies to form "pI antibodies". pI variants are made by introducing amino acid mutations into the parent molecule. "Mutations" in this context are usually amino acid substitutions, although as shown herein, deletions and insertions of amino acids can also be done and thus are defined as mutations.

By "pI variants" or "isoelectric point variants" or "pI substitutions" or grammatical equivalents thereof herein is meant a variant that has a different amino acid than the starting protein resulting in an altered pI at that position. This includes amino acid substitution(s) with a lower pI than the original (e.g. wild type) amino acid at the particular position. In some embodiments, this can also mean deleting an amino acid with a high pI (if the structure will tolerate it) or inserting amino acids with lower pIs, for example the low pI "tails" discussed below. Similarly, these pI variants can include amino acid substitution(s) with a higher pI than the original (e.g. wild type) amino acid at the particular position. In some embodiments, this can also mean deleting an amino acid with a low pI (if the structure will tolerate it) or inserting amino acids with higher pIs, for example high pI "tails" at the C-terminus, discussed below.

As shown in FIG. 36, the different amino acids have different pIs, although this figure shows the pI of amino acids as individual compositions rather than in the context of a protein, although the trend is identical. pI variants in the context of the invention are made to contribute to the decrease of the pI of the protein, in this case at least the heavy constant domain or the light constant domain of an IgG antibody, or both. An antibody engineered to include one or more of the amino acid mutations outlined herein is sometimes also referred to herein as a "pI antibody".

In general, "pI variants" refer to one or more amino acid modifications that result in an alteration of the pI of the protein. This can be done in several ways, including substituting with an amino acid with a different pI, deleting amino acid(s), or inserting amino acid(s), thus altering the overall pI of the antibody. For example, if one heavy chain is to be altered to lower its pI, a high pI amino acid can be replaced with a lower pI or neutral amino acid, or a neutral amino acid can be replaced with a lower pI amino acid (and all combinations thereof). Similar with the engineering for increased pI chains. (As is noted below, additional non-pI variants are often added to structurally compensate for the pI variants, leading to increased stability, etc.). In the selection of constant domain positions for alteration with a lower or higher pI amino acid, the solvent accessibility of the amino acid is taken into account, although in general it is not the only factor. That is, based on the known structure of IgG molecules, and as shown in FIG. 2, each position will either be fully exposed, fully shielded (e.g. in the interior of the molecule), or partially exposed. This evaluation is shown in FIG. 2 as a "fraction exposed" of each residue in the CH1 domain and in Cκ light. In some embodiments, candidate positions for substitution with different pI amino acids are at least 50% exposed, with exposures of over 60, 70, 80+% finding use in the present invention, as well as those residues that are effectively 100% exposed.

While not shown, the same calculations can be done for the hinge region, CH2 and CH3 of the heavy chain and the CL domain of the light chain, using standard and commercially available programs to calculate the percentage exposure.

The lowering of the pI can be done in one of several ways, either replacing a higher pI amino acid (e.g. positive charge state, for example) with a neutral pI, replacing a higher pI amino acid with a lower or low pI amino acid, or replacing a neutral pI amino acid with a low pI amino acid. In some cases, when the structure allows it, deletions or insertions of one or more amino acids can also be done, e.g. deleting a high pI amino acid or inserting one or more low pI amino acids. Thus, for example, an arginine (pI 11.15) can be replaced by lysine (pI 9.59, still high but lower), a more neutral amino acid like glycine or serine, or by low pI variants such as aspartic acid or glutamic acid.

The raising of pI can be done in a similar manner, either replacing a lower pI amino acid (e.g. negative charge state, for example) with a neutral pI, replacing a lower pI amino acid with a higher or high pI amino acid, or replacing a neutral pI amino acid with a high pI amino acid. In some cases, when the structure allows it, deletions or insertions of one or more amino acids can also be done, e.g. deleting a low pI amino acid or inserting one or more high pI amino acids. Thus, for example, a lysine (pI 9.59) can be replaced with an arginine (pI 11.15) or by a more neutral amino acid like glycine or serine, or by high pI variants such as arginine and lysine.

pI variants are defined as variants by comparison to the starting or parent sequence, which frequently is the wild-type IgG constant domain (either heavy or light or both, as outlined herein). That is, the amino acid at a particular position in the wild-type is referred to as the "native" amino acid, and an amino acid substitution (or deletion or insertion) at this position is referred to as a "non-native" amino acid. For example, many embodiments herein use the IgG1 heavy chain constant region as a parent sequence in which pI mutations are made. Thus, in some embodiments, a "non-native" amino acid is as compared to the IgG1 sequence. For example, at position 119, IgG1 has a serine, and thus the non-native amino acid that can be substituted is glutamic acid. Thus, SEQ ID NO: 193 has a non-native glutamic acid at position 119. Similarly, when starting with IgG2 constant domain(s), the native and non-native amino acids are compared to the wild-type IgG2 sequence.

As will be appreciated by those in the art, it is possible to make fusions or hybrids from the various IgG molecules, as described in US Publication No. 2006/0134150, hereby incorporated by reference in its entirety for its teaching of hybrid IgGs. Thus, for example, SEQ ID NO: 28 is a hybrid IgG1/G2 molecule, and SEQ ID NO: 164 is a hybrid IgG2/G1 molecule. In this context, "non-native" or "non-wild type" substitutions means that the amino acid at the position in question is different from the parent wild-type sequence from whence that position came; that is, if the cross-over point is between amino acids 100 and 101, such that the N-terminus is from IgG1 and the C-terminus is from IgG2, a "non-native" amino acid at position 90 will be compared to the IgG sequence.

Thus, it is possible to use non-wild type IgG domains, e.g. IgG domains that already have variants, as the starting or parent molecule. In these cases, as above, a substitution will be "non-native" as long as it does not revert back to a wild type sequence.

Heavy Chain pI Variants

As is described herein, some embodiments of the invention include the use of two different heavy chain pI variants, e.g. two different monomers, that come together to form a heterodimer with a different pI than either of the homodimers.

In some embodiments, the pI variants are made at least in the CH1 region of the heavy chain domain of an IgG antibody to allow the formation of the heterodimeric pI antibodies of the invention. In this embodiment, the mutations can be independently and optionally selected from position 119, 131, 133, 137, 138, 164, 192, 193, 196, 199, 203, 205, 208, 210, 214, 217 and 219. All possible combinations of these 17 positions can be made; e.g. a monomer of a pI antibody may have 1, 2, 3, 4, 5, 6, 7, 8, 9, 10, 11, 12, 13, 14, 15, 16, or 17 CH1 pI substitutions. In addition, as is described herein, any single or combination CH1 variant(s) can be combined, optionally and individually, with any CH2, CH3, hinge and/or LC variant(s) as well, and/or Fc engineering variants, independently and optionally in any combination, as is further described below.

In addition, the substitution of aspartic acid or glutamic acid at positions 121, 124, 129, 132, 134, 126, 152, 155, 157, 159, 101, 161, 162, 165, 176, 177, 178, 190, 191, 194, 195, 197, 212, 216 and 218 can be made, as shown in FIG. 2

Specific substitutions that find use in lowering the pI of CH1 domains include, but are not limited to, a non-native glutamic acid at position 119; a non-native cysteine at position 131; a non-native arginine, lysine or glutamine at position 133; a non-native glutamic acid at position 137; a non-native serine at position 138; a non-native glutamic acid at position 164; a non native asparagine at position 192; a non native phenylalanine at position 193, a non-native lysine at position 196, a non-native threonine at position 199, a non-native aspartic acid at position 203, a non-native glutamic acid or glutamine at position 205, a non native aspartic acid at position 208, a non-native glutamic acid or glutamine at position 210, a non native threonine at position 214, a non native arginine at position 217 and a non-native cysteine at position 219. As is discussed herein, these substitutions can be made individually and in any combination, with preferred combinations shown in the SEQ ID listings and described below. In some cases, only pI substitutions are done in the CH1 domain, and in others, these substitution(s) are added to other pI variants in other domains in any combination.

With specific regard to human IgG1, when one monomer comprising a variant heavy chain constant domain is to be made more positive (e.g. lower the pI), one or more of the following substitutions can be made: S119E, K133E, K133Q, T164E, K205E, K205Q, N208D, K210E, K210Q, K274E, K320E, K322E, K326E, K334E, R355E, K392E, a deletion of K447, adding peptide (DE)n, wherein n is 1, 2 or 3 (e.g. DE, DEDE, and DEDEDE) at the C-terminus, G137E, N203D, K274Q, R355Q, K392N and Q419E. Other isotypes can be similarly altered. In the case where the heavy chain constant domain is from IgG2-4, R133E and R133Q can also be used.

In addition, when one monomer comprising a variant heavy chain constant domain is to be made more negative (e.g. increase the pI), one or more of the following substitutions can be made (reference is to human IgG1 wild-type but other isotypes can be similarly done): Q196K, P217R, P228R, N276K and H435R. As outlined herein and shown in the figures, these changes are shown relative to IgG1, but all isotypes can be altered this way, as well as isotype hybrids. These changes can be individually and optionally included or excluded in any variant.

In some embodiments, mutations are made in the hinge domain, including positions 221, 222, 223, 224, 225, 233, 234, 235 and 236. It should be noted that changes in 233-236 can be made to increase effector function (along with 327A) in the IgG2 backbone. Thus, pI mutations and particularly substitutions can be made in one or more of positions 221-225, with 1, 2, 3, 4 or 5 mutations finding use in the present invention. Again, all possible combinations are contemplated, alone or with other pI variants in other domains.

Specific substitutions that find use in lowering the pI of hinge domains include, but are not limited to, a deletion at position 221, a non-native valine or threonine at position 222, a deletion at position 223, a non-native glutamic acid at position 224, a deletion at position 225, a deletion at position 235 and a deletion or a non-native alanine at position 236. Again, as above, these mutations can be made individually and in any combination, with preferred combinations shown in the SEQ ID listings and described below. In some cases, only pI substitutions are done in the hinge domain, and in others, these substitution(s) are added to other pI variants in other domains in any combination.

In some embodiments, mutations can be made in the CH2 region, including positions 274, 296, 300, 309, 320, 322, 326, 327, 334 and 339. Again, all possible combinations of these 10 positions can be made; e.g. a pI antibody may have 1, 2, 3, 4, 5, 6, 7, 8, 9 or 10 CH2 pI substitutions, any or all of which can be optionally and independently combined with other pI variants.

Specific substitutions that find use in lowering the pI of CH2 domains include, but are not limited to, a non-native glutamine or glutamic acid at position 274, a non-native phenylalanine at position 296, a non native phenylalanine at position 300, a non-native valine at position 309, a non-native glutamic acid at position 320, a non-native glutamic acid at position 322, a non-native glutamic acid at position 326, a non-native glycine at position 327, a non-native glutamic acid at position 334, a non native threonine at position 339, and all possible combinations within CH2 and with other domains.

In this embodiment, the mutations can be independently and optionally selected from position 355, 384, 392, 397, 419 and 447. All possible combinations of these 6 positions can be made; e.g. a pI antibody may have 1, 2, 3, 4, 5 or 6 CH1 pI mutations. In addition, as is described herein, any single or combination CH3 variant(s) can be combined, optionally and individually, with any CH2, CH1, hinge and LC variant(s) as well, as is further described below.

Specific substitutions that find use in lowering the pI of CH3 domains include, but are not limited to, a non-native glutamine or glutamic acid at position 355, a non-native serine at position 384, a non-native asparagine or glutamic acid at position 392, a non-native methionine at position 397, a non native glutamic acid at position 419, and a deletion or non-native aspartic acid at position 447.

Thus, taken together, any possible combination of the following heavy chain constant domain mutations can be made, with each mutation being optionally included or excluded: a non-native glutamic acid at position 119; a non-native cysteine at position 131; a non-native arginine, lysine or glutamine at position 133; a non-native glutamic acid at position 137; a non-native serine at position 138; a non-native glutamic acid at position 164; a non native asparagine at position 192; a non native phenylalanine at position 193, a non-native lysine at position 196, a non-native threonine at position 199, a non-native aspartic acid at position 203, a non-native glutamic acid or glutamine at position 205, a non native aspartic acid at position 208, a non-native glutamic acid or glutamine at position 210, a non native threonine at position 214, a non native arginine at position 217 and a non-native cysteine at position 219, a deletion at position 221, a non-native valine or threonine at position 222, a deletion at position 223, a non-native glutamic acid at position 224, a deletion at position 225, a deletion at position 235, a deletion at position 221, a non-native valine or threonine at position 222, a deletion at position 223, a non-native glutamic acid at position 224, a deletion at position 225, and a deletion at position 235, a non-native glutamine or glutamic acid at position 274, a non-native phenylalanine at position 296, a non native phenylalanine at position 300, a non-native valine at position 309, a non-native glutamic acid at position 320, a non-native glutamic acid at position 322, a non-native glutamic acid at position 326, a non-native glycine at position 327, a non-native glutamic acid at position 334, a non native threonine at position 339, a non native glutamine or glutamic acid at position 355, a non-native serine at position 384, a non-native asparagine or glutamic acid at position 392, a non-native methionine at position 397, a non native glutamic acid at position 419, and a deletion or non-native aspartic acid at position 447.

Figure 37A:
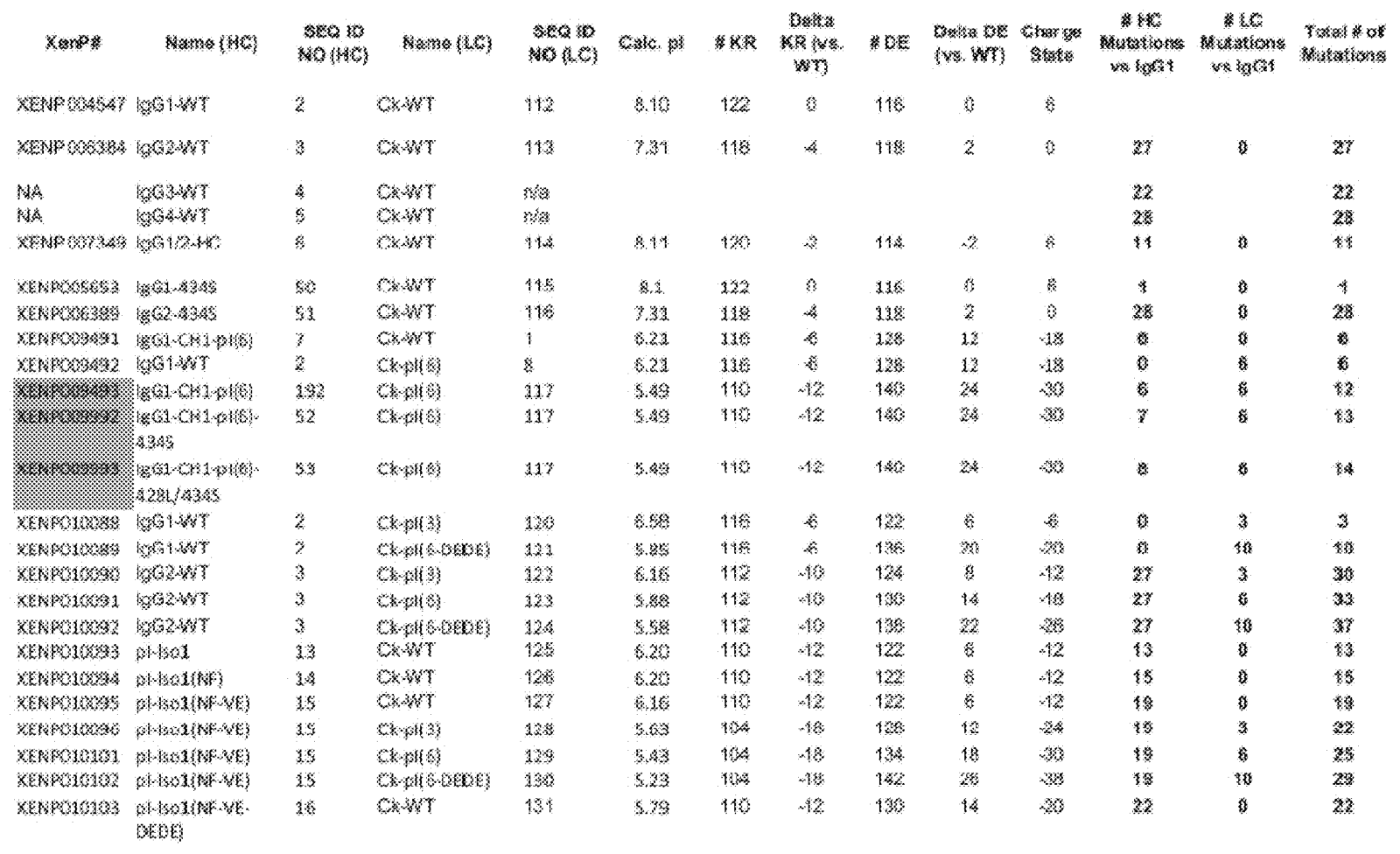
Figure 37B:
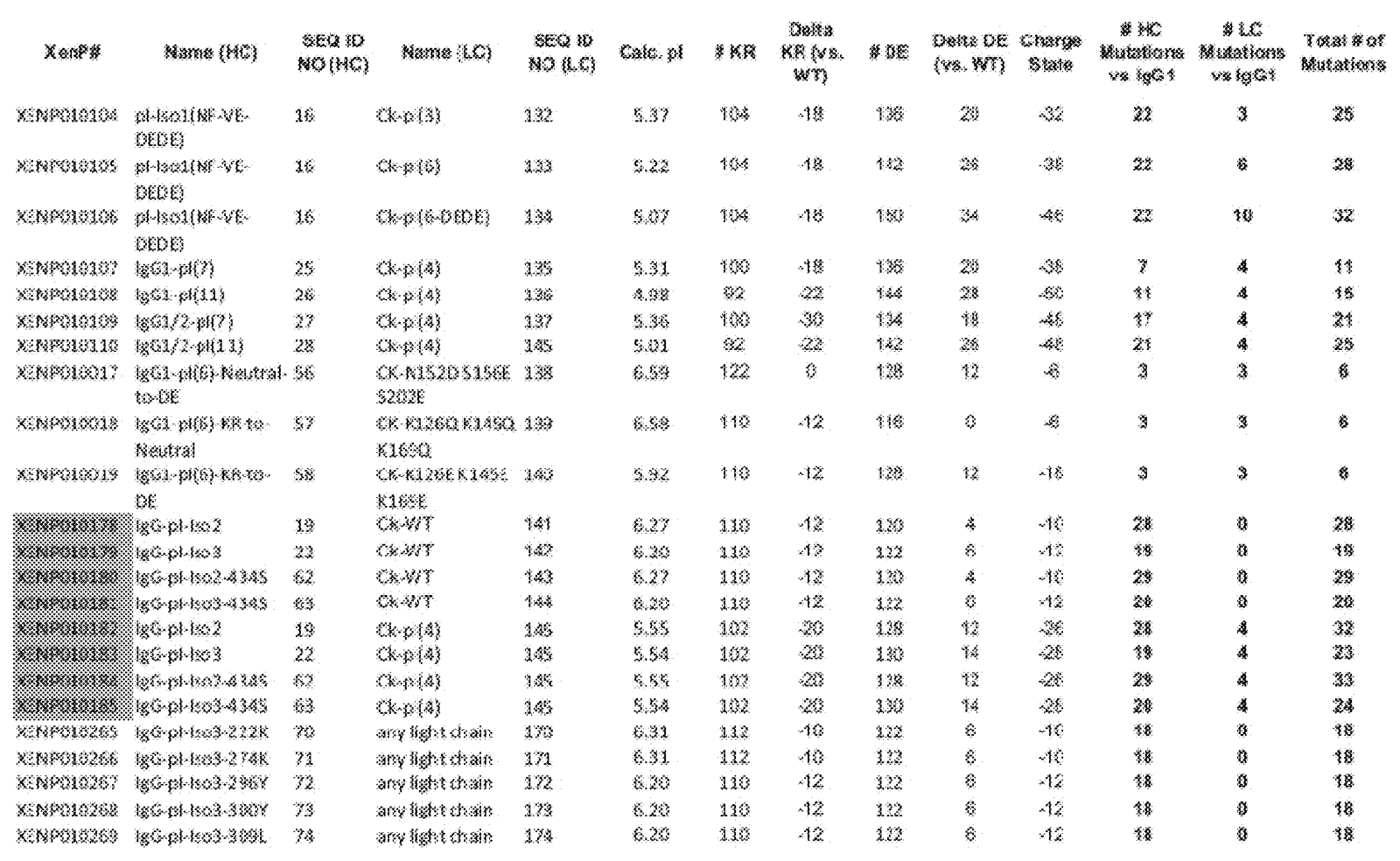
Figure 37C:
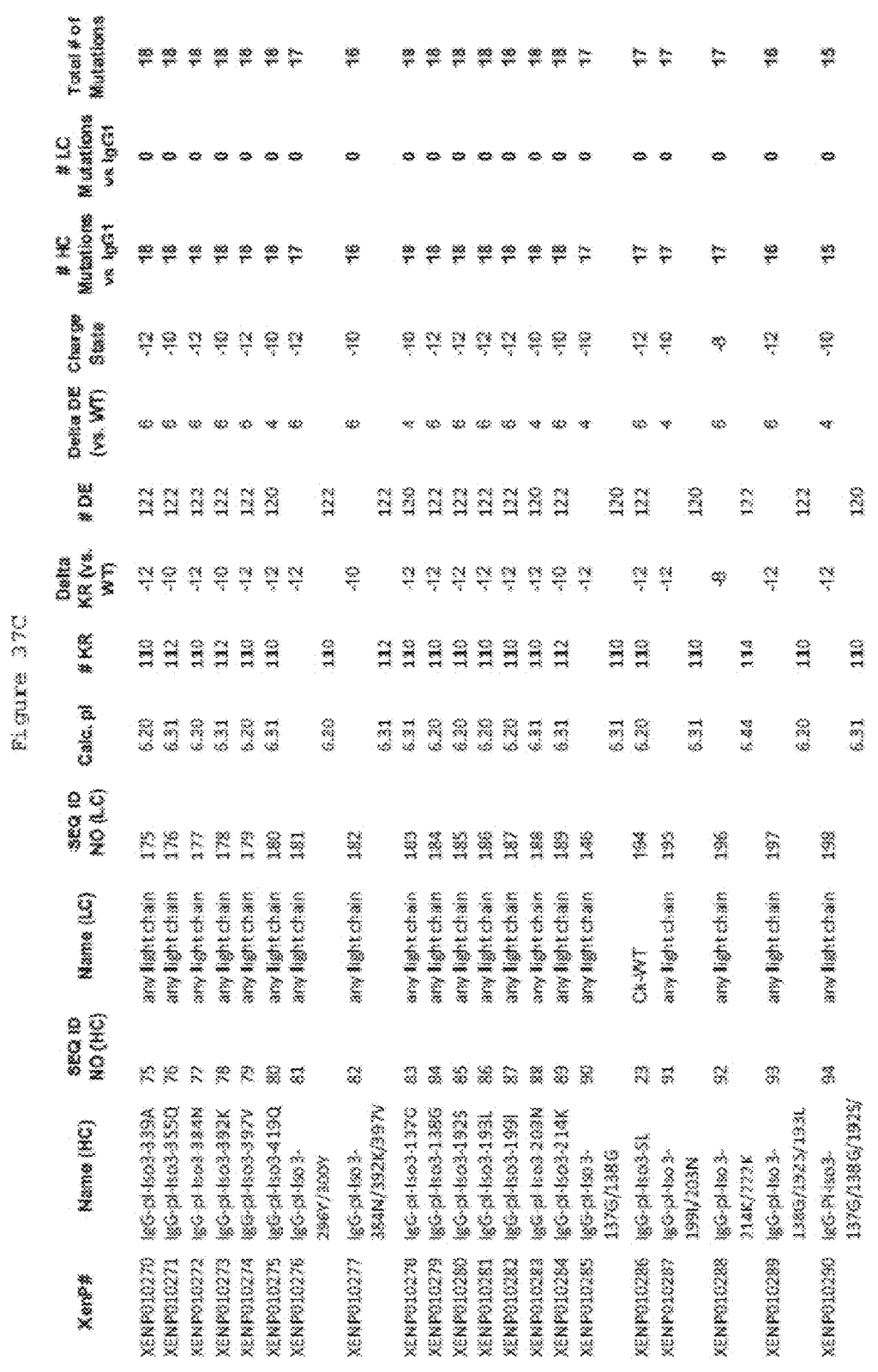

Taken together, some embodiments utilize variant heavy chain domains with 0 (when the pI engineering is done in the light constant domain only), 1, 2, 3, 4, 5, 6, 7, 8, 9, 10, 11, 12, 13, 14, 15, 16, 17, 18, 19, 20, 22, 23, 26, 27, 28 and 29 mutations (as compared to IgG1) can be made, as depicted in FIG. 37.

Preferred embodiments include heterodimers comprising any combination of two different heavy chain pI variants of "ISO(−)". "ISO(+RR)" and "ISO(+)" depicted in FIG. 52, with optional additional variants as described herein.

Light Chain pI Variants

In some embodiments, the pI variants are made at least in the light chain domain of an IgG antibody. In this embodiment, the mutations can be independently and optionally selected from positions 126, 145, 152, 156, 169, 199, 202 and 207. All possible combinations of these 8 positions can be made; e.g. a pI antibody may have 1, 2, 3, 4, 5, 6, 7 or light constant domain pI mutations. In addition, as is described herein, any single or combination CL domain mutations can be combined with any heavy chain constant domain pI variants.

Specific mutations that find use in lowering the pI of light chain constant domains include, but are not limited to, a non-native glutamine or glutamic acid at position 126, a non-native glutamine, glutamic acid or threonine at position 145; a non-native aspartic acid at position 152, a non-native glutamic acid at position 156, a non-native glutamine or glutamic acid at position 169, a non-native glutamic acid at position 199, a non-native glutamic acid at position 202 and a a non-native glutamic acid at position 207.

In the case of antibody based heterodimers, e.g. where at least one of the monomers comprises a light chain in addition to the heavy chain domain, pI variants can also be made in the light chain. Amino acid substitutions for lowering the pI of the light chain include, but are not limited to, K126E, K126Q, K145E, K145Q, N152D, S156E, K169E, S202E, K207E and adding peptide DEDE at the c-terminus of the light chain. Changes in this category based on the constant lambda light chain include one or more substitutions at R108Q, Q124E, K126Q, N138D, K145T and Q199E. In addition, increasing the pI of the light chains can also be done.

Taken together, some embodiments utilize variant light chain domains with 0 (when the pI engineering is done in the heavy constant domain only), 1, 2, 3, 4, 5, 6, or 10 mutations (as compared to CK) can be made, as depicted in FIG. 37.

Isotypic Variants

In addition, many embodiments of the invention rely on the "importation" of pI amino acids at particular positions from one IgG isotype into another, thus reducing or eliminating the possibility of unwanted immunogenicity being introduced into the variants. That is, IgG1 is a common isotype for therapeutic antibodies for a variety of reasons, including high effector function. However, the heavy constant region of IgG1 has a higher pI than that of IgG2 (8.10 versus 7.31). By introducing IgG2 residues at particular positions into the IgG1 backbone, the pI of the resulting monomer is lowered (or increased) and additionally exhibits longer serum half-life. For example, IgG1 has a glycine (pI 5.97) at position 137, and IgG2 has a glutamic acid (pI 3.22); importing the glutamic acid will affect the pI of the resulting protein. As is described below, a number of amino acid substitutions are generally required to significant affect the pI of the variant antibody. However, it should be noted as discussed below that even changes in IgG2 molecules allow for increased serum half-life.

In other embodiments, non-isotypic amino acid changes are made, either to reduce the overall charge state of the resulting protein (e.g. by changing a higher pI amino acid to a lower pI amino acid), or to allow accommodations in structure for stability, etc. as is more further described below.

In addition, by pI engineering both the heavy and light constant domains, significant changes in each monomer of the heterodimer can be seen. As discussed herein, having the pIs of the two monomers differ by at least 0.5 can allow separation.

Calculating pI

The pI of each monomer can depend on the pI of the variant heavy chain constant domain and the pI of the total monomer, including the variant heavy chain constant domain and the fusion partner. Thus, in some embodiments, the change in pI is calculated on the basis of the variant heavy chain constant domain, using the chart in the Figures. Alternatively, the pI of each monomer can be compared.

Heavy and Light Chain pI Variants

As is shown in FIG. 37, a number of pI antibodies have been generated with heavy and light chain pI variants. As outlined herein and specifically meant to be included in the present invention, any pI engineered heavy chain depicted in FIG. 37 and in the sequence listing can be combined with either a wild-type constant light domain or a pI engineered light constant domain. Similarly, an pI engineered light chain constant domain can be combined with either a wild-type constant heavy domain or a pI engineered heavy constant domain, even if not specifically present in FIG. 37. That is, the column of "HC names" and "LC names" are meant to form a matrix, with all possible combinations possible.

Thus, taken together, any possible combination of the following heavy chain constant domain mutations and light chain constant domains can be made, with each mutation being optionally included or excluded: a) heavy chain: a non-native glutamic acid at position 119; a non-native cysteine at position 131; a non-native arginine, lysine or glutamine at position 133; a non-native glutamic acid at position 137; a non-native serine at position 138; a non-native glutamic acid at position 164; a non native asparagine at position 192; a non native phenylalanine at position 193, a non-native lysine at position 196, a non-native threonine at position 199, a non-native aspartic acid at position 203, a non-native glutamic acid or glutamine at position 205, a non native aspartic acid at position 208, a non-native glutamic acid or glutamine at position 210, a non native threonine at position 214, a non native arginine at position 217 and a non-native cysteine at position 219, a deletion at position 221, a non-native valine or threonine at position 222, a deletion at position 223, a non-native glutamic acid at position 224, a deletion at position 225, a deletion at position 235, a deletion at position 221, a non-native valine or threonine at position 222, a deletion at position 223, a non-native glutamic acid at position 224, a deletion at position 225, and a deletion at position 235, a non-native glutamine or glutamic acid at position 274, a non-native phenylalanine at position 296, a non native phenylalanine at position 300, a non-native valine at position 309, a non-native glutamic acid at position 320, a non-native glutamic acid at position 322, a non-native glutamic acid at position 326, a non-native glycine at position 327, a non-native glutamic acid at position 334, a non native threonine at position 339, a non native glutamine or glutamic acid at position 355, a non-native serine at position 384, a non-native asparagine or glutamic acid at position 392, a non-native methionine at position 397, a non native glutamic acid at position 419, and a deletion or non-native aspartic acid at position 447; and b) light chain: a non-native glutamine or glutamic acid at position 126, a non-native glutamine, glutamic acid or threonine at position 145; a non-native aspartic acid at position 152, a non-native glutamic acid at position 156, a non-native glutamine or glutamic acid at position 169, a non-native glutamic acid at position 199, a non-native glutamic acid at position 202 and a a non-native glutamic acid at position 207.

Similarly, the number of mutations that can be generated in suitable pairs of heavy and light constant domains are shown in FIG. 37 ("total # of mutations" column), ranging from 1 to 37.

Properties of the pI Antibodies of the Invention

The pI antibodies of the present invention have different heavy chain domains that have altered pIs, resulting in ease of purifying heterodimeric antibodies. In general, differences of at least 0.1 to 0.5 log (e.g. corresponding to 10% to half a pH point) allow this purification benefit, with alterations of at least about 1, 1.5, 2, 2.5 and 3 finding particular use in the invention. The pI can be either calculated or determined experimentally, as is well known in the art. In addition, it appears that pI antibodies with pIs ranging from 5. to 5.5 to 6 exhibit good extended serum half lives. As will be appreciated by those in the art and depicted in FIG. 30, pIs lower than this are difficult to achieve, as more and more mutations are required and the physical limits are reached.

Figure 34:
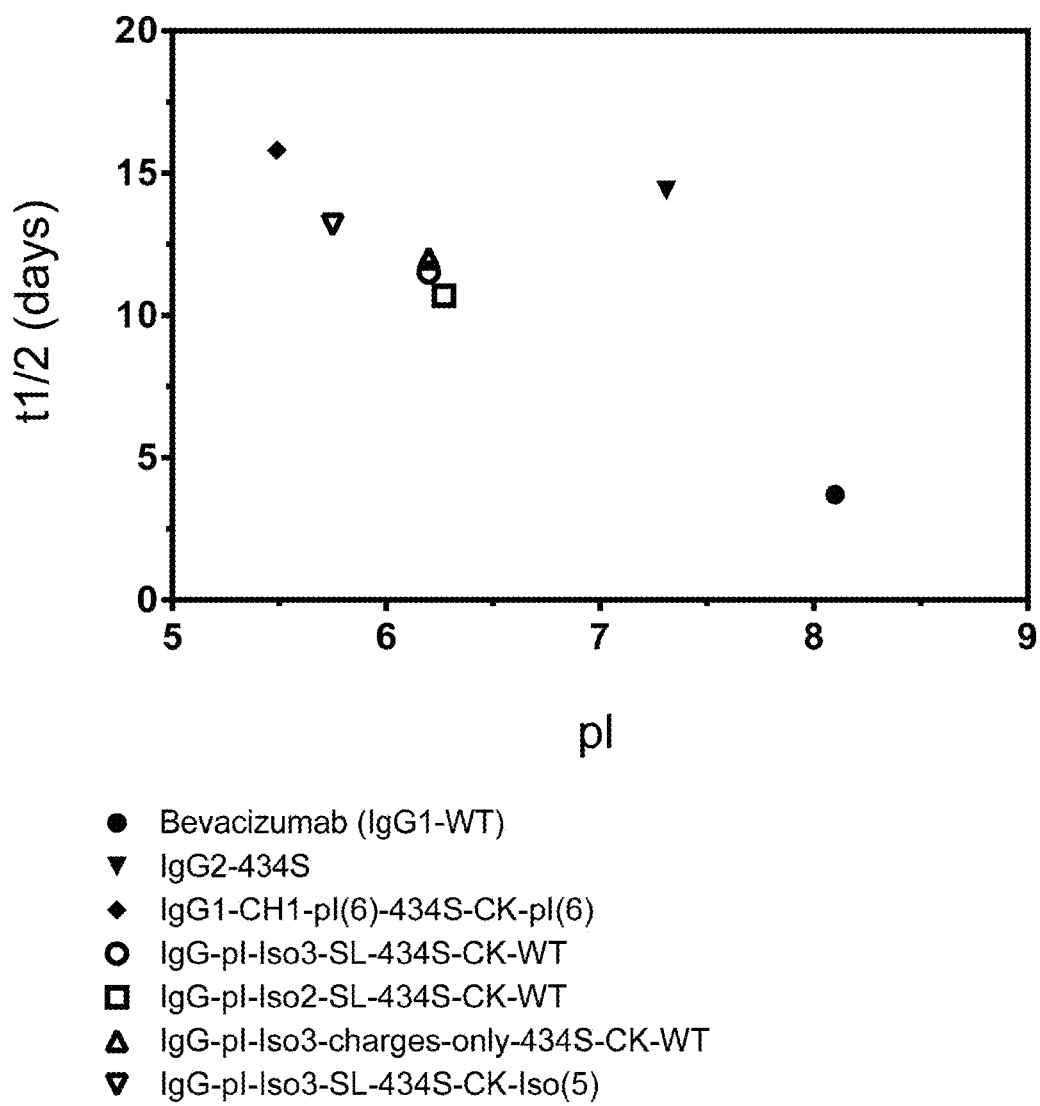
FIG. 34. Plot showing correlation between pI engineered variant pI and half-life (t1/2).

In some embodiments, the pI antibodies of the present invention display increased serum half life. As shown in the Figures, surprisingly, every tested pI antibody has exhibited an increase in half life as compared to the starting molecule. While half-life is affected by a number of factors, including the Fv portion, increases of 25, 50, 75, 100, 150, 200 and 250% or more can be obtained using the pI antibodies of the present invention. As shown in FIG. 34, pI variants can increase half-life from around 4 days to over 15.

In addition, some variants herein are generated to increase stability. As noted herein, a number of properties of antibodies affect the clearance rate (e.g. stability for half-life) in vivo. In addition to antibody binding to the FcRn receptor, other factors that contribute to clearance and half-life are serum aggregation, enzymatic degradation in the serum, inherent immunogenicity of the antibody leading to clearing by the immune system, antigen-mediated uptake, FcR (non-FcRn) mediated uptake and non-serum distribution (e.g. in different tissue compartments).

Accordingly, some additional amino acid substitutions can be made that effect one or more of these properties. As shown in FIG. 37, this include, but are not limited to, 222K, 274K, 296Y, 300Y, 339A, 355R, 384N, 392K, 397V, 419Q, 296Y/300Y, 384N/392K/397V, 137G, 138G, 192S, 193L, 199I, 203N, 214K, 137G/138G, 192S/193L, 199I/203N, 214K/222K, 138G/192S/193L and 137G/138G/192S/193L.

III. Other Amino Acid Substitutions

As will be appreciated by those in the art, the pI antibodies of the invention can contain additional amino acid substitutions in addition to the pI variants.

In some embodiments, amino acid substitutions are imported from one isotype into the pI antibody despite either a neutrality of charge state or even an increase of charge state, so as to accommodate the pI variants. These are sometimes referred to as "non-pI isotypic variants" or "accommodation variants". For example, the replacement of the native lysine at position 133 of IgG1 with an arginine from IgG2 is such a change, as is the replacement of the native glutamine in IgG1 at position 196 with the IgG2 lysine, the replacement of native IgG1 proline at position 217 with the IgG2 arginine, etc. It should be noted in this instance that as described above, pI variants can be made at position 133 as well, substituting non-native glutamic acid or glutamine at position 133.

In the hinge region (positions 233-236), changes can be made to increase effector function. That is, IgG2 has lowered effector function, and as a result, amino acid substitutions at these positions from PVA(deletion) can be changed to ELLG, and an additional G327A variant generated as well.

In the CH3 region, a mutation at position 384 can be made, for example substituting a non-native serine.

Additional mutations that can be made include adding either N-terminal or C-terminal (depending on the structure of the antibody or fusion protein) "tails" or sequences of one or more low or high pI amino acids; for example, glutamic acids and aspartic acids can be added to the CH3 C-terminus or arginines or lysines; generally, from 1 to 5 amino acids are added, with 1, 2 and 4 being of particular use.

In some embodiments, for example for embodiments utilizing one binding site to CD3 and one to a tumor antigen (ideologically similar to the "BITE™" (artificial bispecific monoclonal antibodies) from Micromet), it may be desirable to knock out all binding of the Fc region to Fc gamma receptors, to decrease or eliminate effector function. In this embodiment, the incorporation of either or both 236R and 328R can be optionally and independently included or excluded in any combination of variants outlined herein.

"Knobs and Holes" Heterodimeric Variants

In addition to the pI variants discussed above, the formation of heterodimers can be facilitated by the addition of steric variants. That is, by changing amino acids in each heavy chain, different heavy chains are more likely to associate to form the heterodimeric structure than to form homodimers with the same Fc amino acid sequences. Thus again, as for the pI purification variants, these variants are meant to be used as "pairs" or "sets", with one heavy chain being changed to include one set of substitutions and the other chain to include the corresponding set.

Thus, in addition to pI variants as discussed above, one or both variant heavy chain region can also optionally include one or more of the following variants. In one embodiment of the invention, said variant Fc regions comprise at least one substitution at a position selected from the group consisting of 349, 351, 354, 356, 357, 364, 366, 368, 370, 392, 394, 395, 396, 397, 399, 401, 405, 407, 409, 411, and 439, wherein numbering is according to the EU index as in Kabat. In a preferred embodiment, said variant Fc regions comprise at least one substitution selected from the group consisting of 349A, 349C, 349E, 349I, 349K, 349S, 349T, 349W, 351E, 351K, 354C, 356K, 357K, 364C, 364D, 364E, 364F, 364G, 364H, 364R, 364T, 364Y, 366D, 366K, 366S, 366W, 366Y, 368A, 368E, 368K, 368S, 370C, 370D, 370E, 370G, 370R, 370S, 370V, 392D, 392E, 394F, 394S, 394W, 394Y, 395T, 395V, 396T, 397E, 397S, 397T, 399K, 401K, 405A, 405S, 407T, 407V, 409D, 409E, 411D, 411E, 411K, and 439D.

In some embodiments, the steric variants outlined herein can be optionally and independently incorporated with any pI variant into a monomer.

Figure 7:
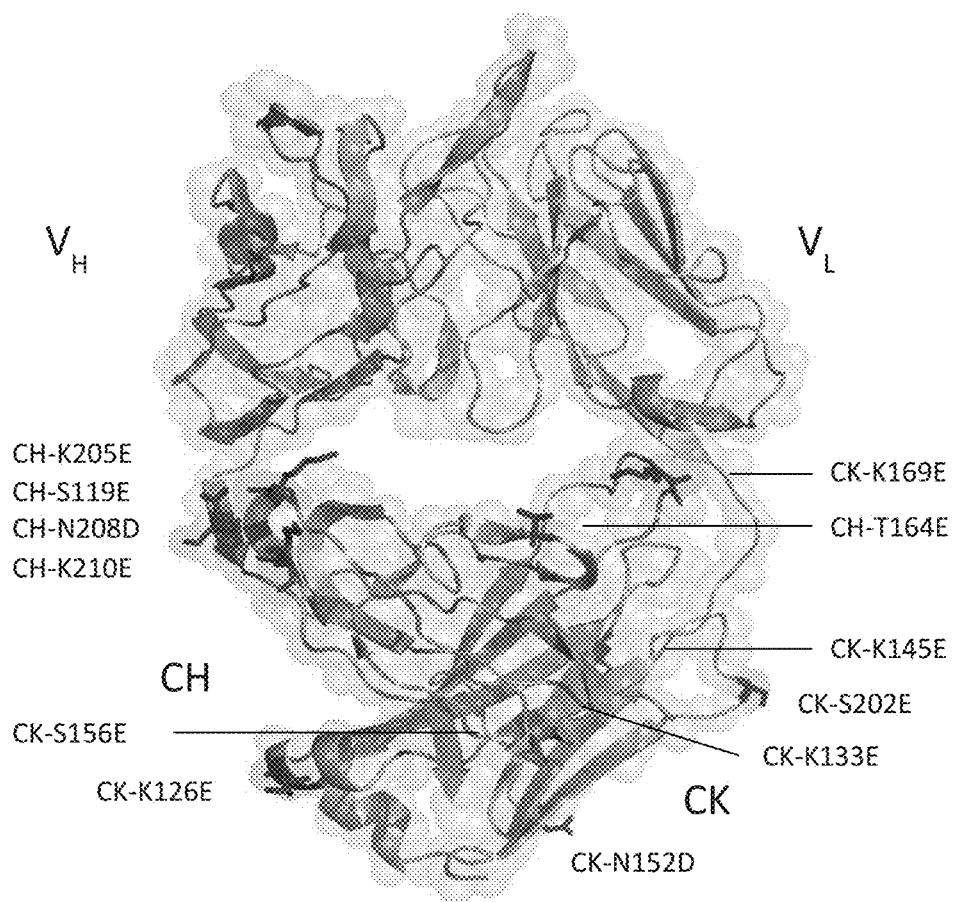
FIG. 7. Structure of an antibody Fab domain showing the locations of pI lowering mutations in XENP9493 IgG1-CH1-pI(6)-CK-pI(6).

In some embodiments, each monomer of the heterodimer is engineered to contain one or more steric variants; that is, one monomer contains at least one variant and the other monomer contains a different variant as is shown in Tables 1 and 2, below, and FIGS. 5-7 of U.S. Ser. No. 12/897,015, incorporated by reference.

Variant Fc regions for which the heterodimer content is increased over that of wild-type are preferred. Variants tested in Table 1. Preferred variant pairs are provided in Table 2:

TABLE 1

Preferred substitutions

| Variant 1 | Variant 2 |
|---|---|
| F405A | T394F |
| S364D | Y349K |
| S364E | L368K |
| S364E | Y349K |
| S364F | K370G |
| S364H | Y349K |
| S364H | Y349T |
| S364Y | K370G |
| T411K | K370E |
| V397S/F405A | T394F |
| K370R/T411K | K370E/T411E |
| L351E/S364D | Y349K/L351K |
| L351E/S364E | Y349K/L351K |
| L351E/T366D | L351K/T366K |
| P395T/V397S/F405A | T394F |
| S364D/K370G | S364Y/K370R |
| S364D/T394F | Y349K/F405A |
| S364E/F405A | Y349K/T394F |
| S364E/F405S | Y349K/T394Y |
| S364E/T411E | Y349K/D401K |
| S364E/D401K | Y349T/T411E |
| S364H/F405A | Y349T/T394F |
| S364H/T394F | Y349T/F405A |
| Y349C/S364E | Y349K/S354C |
| L351E/S364D/F405A | Y349K/L351K/T394F |
| L351K/S364H/D401K | Y349T/L351E/T411E |
| S364E/T411E/F405A | Y349K/T394F/D401K |
| S364H/D401K/F405A | Y349T/T394F/T411E |
| S364H/F405A/T411E | Y349T/T394F/D401K |

TABLE 2

Especially preferred substitutions

| Variant 1 | Variant 2 |
|---|---|
| F405A | T394F |
| S364D | Y349K |
| S364E | Y349K |
| S364H | Y349T |
| L351K | L351E |
| D401K | T411E |
| S364D/T394F | Y349K/F405A |
| S364E/F405A | Y349K/T394F |
| S364H/D401K | Y349T/T411E |
| S364H/F405A | Y349T/T394F |

TABLE 2-continued

Especially preferred substitutions

| Variant 1 | Variant 2 |
|---|---|
| S364H/T394F | Y349T/F405A |
| L351K/S364H/D401K | Y349T/L351E/T411E |
| S364H/D401K/F405A | Y349T/T394F/T411E |
| S364H/F405A/T411E | Y349T/T394F/D401K |

IV. Optional and Additional Fc Engineering

FcRn Modifications

In some embodiments, the pI variants of the present invention can be combined with amino acid substitutions in the FcRn binding domain. Surprisingly, the present invention shows that pI variants can be independently and optionally combined with Fc variants that result in good bispecific formation, higher binding to the FcRn receptor as well as increased half-lives.

By "FcRn" or "neonatal Fc Receptor" as used herein is meant a protein that binds the IgG antibody Fc region and is encoded at least in part by an FcRn gene. The FcRn may be from any organism, including but not limited to humans, mice, rats, rabbits, and monkeys. As is known in the art, the functional FcRn protein comprises two polypeptides, often referred to as the heavy chain and light chain. The light chain is beta-2-microglobulin and the heavy chain is encoded by the FcRn gene. Unless other wise noted herein, FcRn or an FcRn protein refers to the complex of FcRn heavy chain with beta-2-microglobulin. In some cases, the FcRn variants bind to the human FcRn receptor, or it may be desirable to design variants that bind to rodent or primate receptors in addition, to facilitate clinical trials.

A variety of such substitutions are known and described in U.S. Ser. No. 12/341,769, hereby incorporated in its entirety and specifically for the recitation of specific variants that increase FcRn binding and/or serum half life. In some embodiments, a pI antibody can be engineered to include any of the following substitutions, alone or in any combination: 436I, 436V, 311I, 311V, 428L, 434S, 428L/434S, 259I, 308F, 259I/308F, 259I/308F/428L, 307Q/434S, 434A, 434H, 250Q/428L, M252Y/S254T/T256E, 307Q/434A, 307Q/380A/434A, and 308P/434A. Numbering is EU as in Kabat, and it is understood that the substitution is non-native to the starting molecule. As has been shown previously, these FcRn substitutions work in IgG1, IgG2 and IgG1/G2 hybrid backbones, and are specifically included for IgG3 and IgG4 backbones and derivatives of any IgG isoform as well.

In some embodiments, it is also possible to do pI engineering on variable regions, either framework or CDRs, as is generally described in US Publication 2011/0076275, expressly incorporated herein by reference.

In other embodiments, no pI variants are made in the variable region(s) of the antibodies, e.g. no amino acid substitutions are made that purposefully decrease the pI of the amino acid at a position, nor of the total protein. This is to be distinguished from affinity maturation substitutions in the variable region(s) that are made to increase binding affinity of the antibody to its antigen but may result in a lower pI amino acid being added. That is, a pI variant in the variable region(s) is generally significantly "silent" with respect to binding affinity.

Fc Engineering

In addition to substitutions made to increase binding affinity to FcRn and/or increase serum half life, other substitutions can be made in the Fc region, in general for altering binding to FcγR receptors.

By "Fc gamma receptor", "FcγR" or "FcgammaR" as used herein is meant any member of the family of proteins that bind the IgG antibody Fc region and is encoded by an FcγR gene. In humans this family includes but is not limited to FcγRI (CD64), including isoforms FcγRIa, FcγRIb, and FcγRIc; FcγRII (CD32), including isoforms FcγRIIa (including allotypes H131 and R131), FcγRIIb (including FcγRIIb-1 and FcγRIIb-2), and FcγRIIc; and FcγRIII (CD16), including isoforms FcγRIIIa (including allotypes V158 and F158) and FcγRIIIb (including allotypes FcγRIIIb-NA1 and FcγRIIIb-NA2) (Jefferis et al., 2002, Immunol Lett 82:57-65, entirely incorporated by reference), as well as any undiscovered human FcγRs or FcγR isoforms or allotypes. An FcγR may be from any organism, including but not limited to humans, mice, rats, rabbits, and monkeys. Mouse FcγRs include but are not limited to FcγRI (CD64), FcγRII (CD32), FcγRIII-1 (CD16), and FcγRIII-2 (CD16-2), as well as any undiscovered mouse FcγRs or FcγR isoforms or allotypes.

There are a number of useful Fc substitutions that can be made to alter binding to one or more of the FcγR receptors. Substitutions that result in increased binding as well as decreased binding can be useful. For example, it is known that increased binding to FcγRIIIa generally results in increased ADCC (antibody dependent cell-mediated cytotoxicity; the cell-mediated reaction wherein nonspecific cytotoxic cells that express FcγRs recognize bound antibody on a target cell and subsequently cause lysis of the target cell. Similarly, decreased binding to FcγRIIb (an inhibitory receptor) can be beneficial as well in some circumstances. Amino acid substitutions that find use in the present invention include those listed in U.S. Ser. No. 11/124,620 (particularly FIG. 41), Ser. Nos. 11/174,287, 11/396,495, 11/538,406, all of which are expressly incorporated herein by reference in their entirety and specifically for the variants disclosed therein. Particular variants that find use include, but are not limited to, 236A, 239D, 239E, 332E, 332D, 239D/332E, 267D, 267E, 328F, 267E/328F, 236A/332E, 239D/332E/330Y, 239D, 332E/330L and 299T.

V. Other Antibody Modifications

Affinity Maturation

In some embodiments, one or more amino acid modifications are made in one or more of the CDRs of the antibody. In general, only 1 or 2 or 3 amino acids are substituted in any single CDR, and generally no more than from 4, 5, 6, 7, 8 9 or 10 changes are made within a set of CDRs. However, it should be appreciated that any combination of no substitutions, 1, 2 or 3 substitutions in any CDR can be independently and optionally combined with any other substitution.

In some cases, amino acid modifications in the CDRs are referred to as "affinity maturation". An "affinity matured" antibody is one having one or more alteration(s) in one or more CDRs which results in an improvement in the affinity of the antibody for antigen, compared to a parent antibody which does not possess those alteration(s). In some cases, although rare, it may be desirable to decrease the affinity of an antibody to its antigen, but this is generally not preferred.

Affinity maturation can be done to increase the binding affinity of the antibody for the antigen by at least about 10% to 50-100-150% or more, or from 1 to 5 fold as compared to the "parent" antibody. Preferred affinity matured antibodies will have nanomolar or even picomolar affinities for the target antigen. Affinity matured antibodies are produced by known procedures. See, for example, Marks et al., 1992, Biotechnology 10:779-783 that describes affinity maturation by variable heavy chain (VH) and variable light chain (VL) domain shuffling. Random mutagenesis of CDR and/or framework residues is described in: Barbas, et al. 1994, Proc. Nat. Acad. Sci, USA 91:3809-3813; Shier et al., 1995, Gene 169:147-155; Yelton et al., 1995, J. Immunol. 155: 1994-2004; Jackson et al., 1995, J. Immunol. 154(7):3310-9; and Hawkins et al, 1992, J. Mol. Biol. 226:889-896, for example.

Alternatively, amino acid modifications can be made in one or more of the CDRs of the antibodies of the invention that are "silent", e.g. that do not significantly alter the affinity of the antibody for the antigen. These can be made for a number of reasons, including optimizing expression (as can be done for the nucleic acids encoding the antibodies of the invention).

Thus, included within the definition of the CDRs and antibodies of the invention are variant CDRs and antibodies; that is, the antibodies of the invention can include amino acid modifications in one or more of the CDRs of Ab79 and Ab19. In addition, as outlined below, amino acid modifications can also independently and optionally be made in any region outside the CDRs, including framework and constant regions.

ADC Modifications

In some embodiments, the pI antibodies of the invention are conjugated with drugs to form antibody-drug conjugates (ADCs). In general, ADCs are used in oncology applications, where the use of antibody-drug conjugates for the local delivery of cytotoxic or cytostatic agents allows for the targeted delivery of the drug moiety to tumors, which can allow higher efficacy, lower toxicity, etc. An overview of this technology is provided in Ducry et al., Bioconjugate Chem., 21:5-13 (2010), Carter et al., Cancer J. 14(3):154 (2008) and Senter, Current Opin. Chem. Biol. 13:235-244 (2009), all of which are hereby incorporated by reference in their entirety Thus the invention provides pI antibodies conjugated to drugs. Generally, conjugation is done by covalent attachment to the antibody, as further described below, and generally relies on a linker, often a peptide linkage (which, as described below, may be designed to be sensitive to cleavage by proteases at the target site or not). In addition, as described above, linkage of the linker-drug unit (LU-D) can be done by attachment to cysteines within the antibody. As will be appreciated by those in the art, the number of drug moieties per antibody can change, depending on the conditions of the reaction, and can vary from 1:1 to 10:1 drug: antibody. As will be appreciated by those in the art, the actual number is an average.

Thus the invention provides pI antibodies conjugated to drugs. As described below, the drug of the ADC can be any number of agents, including but not limited to cytotoxic agents such as chemotherapeutic agents, growth inhibitory agents, toxins (for example, an enzymatically active toxin of bacterial, fungal, plant, or animal origin, or fragments thereof), or a radioactive isotope (that is, a radioconjugate) are provided. In other embodiments, the invention further provides methods of using the ADCs.

Drugs for use in the present invention include cytotoxic drugs, particularly those which are used for cancer therapy. Such drugs include, in general, DNA damaging agents, anti-metabolites, natural products and their analogs. Exemplary classes of cytotoxic agents include the enzyme inhibitors such as dihydrofolate reductase inhibitors, and thymidylate synthase inhibitors, DNA intercalators, DNA cleavers, topoisomerase inhibitors, the anthracycline family of drugs, the vinca drugs, the mitomycins, the bleomycins, the cytotoxic nucleosides, the pteridine family of drugs, diynenes, the podophyllotoxins, dolastatins, maytansinoids, differentiation inducers, and taxols.

Members of these classes include, for example, methotrexate, methopterin, dichloromethotrexate, 5-fluorouracil, 6-mercaptopurine, cytosine arabinoside, melphalan, leurosine, leurosideine, actinomycin, daunorubicin, doxorubicin, mitomycin C, mitomycin A, caminomycin, aminopterin, tallysomycin, podophyllotoxin and podophyllotoxin derivatives such as etoposide or etoposide phosphate, vinblastine, vincristine, vindesine, taxanes including taxol, taxotere retinoic acid, butyric acid, N8-acetyl spermidine, camptothecin, calicheamicin, esperamicin, ene-diynes, duocarmycin A, duocarmycin SA, calicheamicin, camptothecin, maytansinoids (including DM1), monomethylauristatin E (MMAE), monomethylauristatin F (MMAF), and maytansinoids (DM4) and their analogues.

Toxins may be used as antibody-toxin conjugates and include bacterial toxins such as diphtheria toxin, plant toxins such as ricin, small molecule toxins such as geldanamycin (Mandler et al (2000) J. Nat. Cancer Inst. 92(19):1573-1581; Mandler et al (2000) Bioorganic & Med. Chem. Letters 10:1025-1028; Mandler et al (2002) Bioconjugate Chem. 13:786-791), maytansinoids (EP 1391213; Liu et al., (1996) Proc. Natl. Acad. Sci. USA 93:8618-8623), and calicheamicin (Lode et al (1998) Cancer Res. 58:2928; Hinman et al (1993) Cancer Res. 53:3336-3342). Toxins may exert their cytotoxic and cytostatic effects by mechanisms including tubulin binding, DNA binding, or topoisomerase inhibition.

Conjugates of an pI antibody and one or more small molecule toxins, such as a maytansinoids, dolastatins, auristatins, a trichothecene, calicheamicin, and CC1065, and the derivatives of these toxins that have toxin activity, are contemplated.

Maytansinoids

Maytansine compounds suitable for use as maytansinoid drug moieties are well known in the art, and can be isolated from natural sources according to known methods, produced using genetic engineering techniques (see Yu et al (2002) PNAS 99:7968-7973), or maytansinol and maytansinol analogues prepared synthetically according to known methods. As described below, drugs may be modified by the incorporation of a functionally active group such as a thiol or amine group for conjugation to the antibody.

Exemplary maytansinoid drug moieties include those having a modified aromatic ring, such as: C-19-dechloro (U.S. Pat. No. 4,256,746) (prepared by lithium aluminum hydride reduction of ansamytocin P2); C-20-hydroxy (or C-20-demethyl)+/−C-19-dechloro (U.S. Pat. Nos. 4,361,650 and 4,307,016) (prepared by demethylation using *Streptomyces* or *Actinomyces* or dechlorination using LAH); and C-20-demethoxy, C-20-acyloxy (—OCOR), +/−dechloro (U.S. Pat. No. 4,294,757) (prepared by acylation using acyl chlorides) and those having modifications at other positions Exemplary maytansinoid drug moieties also include those having modifications such as: C-9-SH (U.S. Pat. No. 4,424, 219) (prepared by the reaction of maytansinol with H2S or P2S5); C-14-alkoxymethyl(demethoxy/CH2OR) (U.S. Pat. No. 4,331,598); C-14-hydroxymethyl or acyloxymethyl (CH2OH or CH2O Ac) (U.S. Pat. No. 4,450,254) (prepared fromNocardia); C-15-hydroxy/acyloxy (U.S. Pat. No. 4,364, 866) (prepared by the conversion of maytansinol by *Streptomyces*); C-15-methoxy (U.S. Pat. Nos. 4,313,946 and 4,315,929) (isolated from *Trewia nudlflora*); C-18-N-demethyl (U.S. Pat. Nos. 4,362,663 and 4,322,348) (prepared by the demethylation of maytansinol by *Streptomyces*); and 4,5-deoxy (U.S. Pat. No. 4,371,533) (prepared by the titanium trichloride/LAH reduction of maytansinol).

Of particular use are DM1 (disclosed in U.S. Pat. No. 5,208,020, incorporated by reference) and DM4 (disclosed in U.S. Pat. No. 7,276,497, incorporated by reference). See also a number of additional maytansinoid derivatives and methods in 5,416,064, WO/01/24763, 7,303,749, 7,601,354, U.S. Ser. No. 12/631,508, WO02/098883, 6,441,163, 7,368,565, WO02/16368 and WO04/1033272, all of which are expressly incorporated by reference in their entirety.

ADCs containing maytansinoids, methods of making same, and their therapeutic use are disclosed, for example, in U.S. Pat. Nos. 5,208,020; 5,416,064; 6,441,163 and European Patent EP 0 425 235 B1, the disclosures of which are hereby expressly incorporated by reference. Liu et al., Proc. Natl. Acad. Sci. USA 93:8618-8623 (1996) described ADCs comprising a maytansinoid designated DM1 linked to the monoclonal antibody C242 directed against human colorectal cancer. The conjugate was found to be highly cytotoxic towards cultured colon cancer cells, and showed antitumor activity in an in vivo tumor growth assay.

Chari et al., Cancer Research 52:127-131 (1992) describe ADCs in which a maytansinoid was conjugated via a disulfide linker to the murine antibody A7 binding to an antigen on human colon cancer cell lines, or to another murine monoclonal antibody TA.1 that binds the HER-2/neu oncogene. The cytotoxicity of the TA.1-maytansonoid conjugate was tested in vitro on the human breast cancer cell line SK-BR-3, which expresses 3×105 HER-2 surface antigens per cell. The drug conjugate achieved a degree of cytotoxicity similar to the free maytansinoid drug, which could be increased by increasing the number of maytansinoid molecules per antibody molecule. The A7-maytansinoid conjugate showed low systemic cytotoxicity in mice.

Auristatins and Dolastatins

In some embodiments, the ADC comprises an pI antibody conjugated to dolastatins or dolostatin peptidic analogs and derivatives, the auristatins (U.S. Pat. Nos. 5,635,483; 5,780,588). Dolastatins and auristatins have been shown to interfere with microtubule dynamics, GTP hydrolysis, and nuclear and cellular division (Woyke et al (2001) Antimicrob. Agents and Chemother. 45(12):3580-3584) and have anticancer (U.S. Pat. No. 5,663,149) and antifungal activity (Pettit et al (1998) Antimicrob. Agents Chemother. 42:2961-2965). The dolastatin or auristatin drug moiety may be attached to the antibody through the N (amino) terminus or the C (carboxyl) terminus of the peptidic drug moiety (WO 02/088172).

Exemplary auristatin embodiments include the N-terminus linked monomethylauristatin drug moieties DE and DF, disclosed in "Senter et al, Proceedings of the American Association for Cancer Research, Volume 45, Abstract Number 623, presented Mar. 28, 2004 and described in United States Patent Publication No. 2005/0238648, the disclosure of which is expressly incorporated by reference in its entirety.

Figure 10:
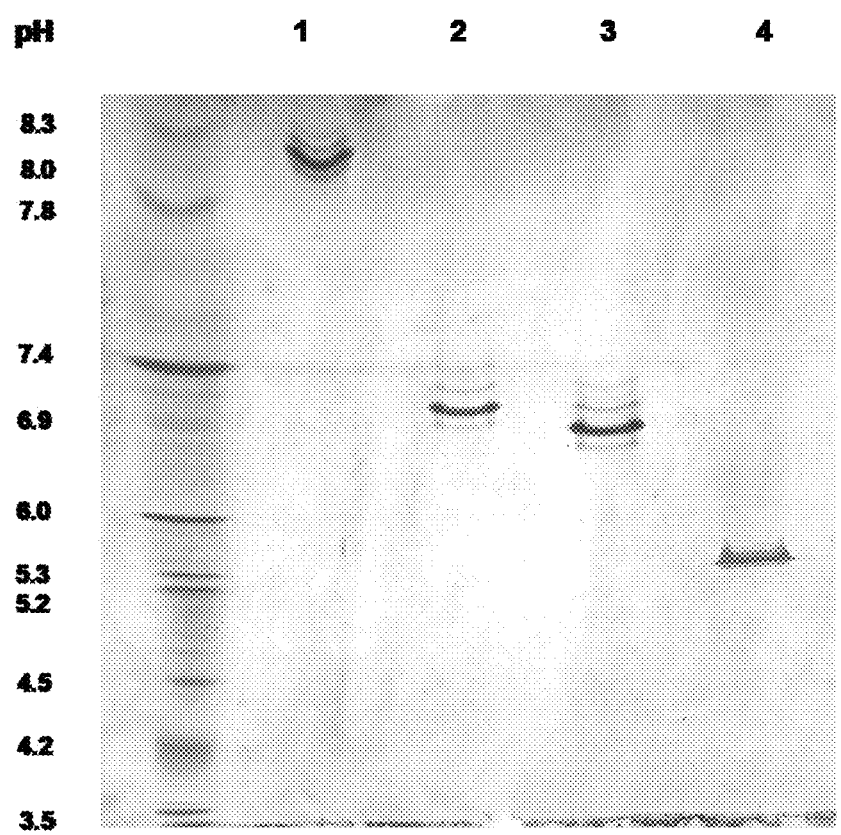
FIG. 10. Analysis of pI engineered anti-VEGF variants on an IEF gel showing variants have altered pI.

An exemplary auristatin embodiment is MMAE (shown in FIG. 10 wherein the wavy line indicates the covalent attachment to a linker (L) of an antibody drug conjugate; see U.S. Pat. No. 6,884,869 expressly incorporated by reference in its entirety).

Another exemplary auristatin embodiment is MMAF, shown in FIG. 10 wherein the wavy line indicates the covalent attachment to a linker (L) of an antibody drug conjugate (US 2005/0238649, U.S. Pat. Nos. 5,767,237 and 6,124,431, expressly incorporated by reference in their entirety):

Additional exemplary embodiments comprising MMAE or MMAF and various linker components (described further herein) have the following structures and abbreviations (wherein Ab means antibody and p is 1 to about 8):

Typically, peptide-based drug moieties can be prepared by forming a peptide bond between two or more amino acids and/or peptide fragments. Such peptide bonds can be prepared, for example, according to the liquid phase synthesis method (see E. Schroder and K. Lubke, "The Peptides", volume 1, pp 76-136, 1965, Academic Press) that is well known in the field of peptide chemistry. The auristatin/dolastatin drug moieties may be prepared according to the methods of: U.S. Pat. Nos. 5,635,483; 5,780,588; Pettit et al (1989) J. Am. Chem. Soc. 111:5463-5465; Pettit et al (1998) Anti-Cancer Drug Design 13:243-277; Pettit, G. R., et al. Synthesis, 1996, 719-725; Pettit et al (1996) J. Chem. Soc. Perkin Trans. 1 5:859-863; and Doronina (2003) Nat Biotechnol 21(7):778-784.

Calicheamicin

In other embodiments, the ADC comprises an antibody of the invention conjugated to one or more calicheamicin molecules. For example, MYLOTARG® (gemtuzumab ozogamicin) is the first commercial ADC drug and utilizes calicheamicin yl as the payload (see U.S. Pat. No. 4,970,198, incorporated by reference in its entirety). Additional calicheamicin derivatives are described in U.S. Pat. Nos. 5,264,586, 5,384,412, 5,550,246, 5,739,116, 5,773,001, 5,767,285 and 5,877,296, all expressly incorporated by reference. The calicheamicin family of antibiotics are capable of producing double-stranded DNA breaks at sub-picomolar concentrations. For the preparation of conjugates of the calicheamicin family, see U.S. Pat. Nos. 5,712,374, 5,714,586, 5,739,116, 5,767,285, 5,770,701, 5,770,710, 5,773,001, 5,877,296 (all to American Cyanamid Company). Structural analogues of calicheamicin which may be used include, but are not limited to, γ1I, α2I, α2I, N-acetyl-γ1I, PSAG and θI1 (Hinman et al., Cancer Research 53:3336-3342 (1993), Lode et al., Cancer Research 58:2925-2928 (1998) and the aforementioned U.S. patents to American Cyanamid). Another anti-tumor drug that the antibody can be conjugated is QFA which is an antifolate. Both calicheamicin and QFA have intracellular sites of action and do not readily cross the plasma membrane. Therefore, cellular uptake of these agents through antibody mediated internalization greatly enhances their cytotoxic effects.

Duocarmycins

CC-1065 (see U.S. Pat. No. 4,169,888, incorporated by reference) and duocarmycins are members of a family of antitumor antibiotics utilized in ADCs. These antibiotics appear to work through sequence-selectively alkylating DNA at the N3 of adenine in the minor groove, which initiates a cascade of events that result in apoptosis.

Important members of the duocarmycins include duocarmycin A (U.S. Pat. No. 4,923,990, incorporated by reference) and duocarmycin SA (U.S. Pat. No. 5,101,038, incorporated by reference), and a large number of analogues as described in U.S. Pat. Nos. 7,517,903, 7,691,962, 5,101,038; 5,641,780; 5,187,186; 5,070,092; 5,070,092; 5,641,780; 5,101,038; 5,084,468, 5,475,092, 5,585,499, 5,846,545, WO2007/089149, WO2009/017394A1, U.S. Pat. Nos. 5,703,080, 6,989,452, 7,087,600, 7,129,261, 7,498,302, and 7,507,420, all of which are expressly incorporated by reference.

VI. Other Cytotoxic Agents

Other antitumor agents that can be conjugated to the antibodies of the invention include BCNU, streptozoicin, vincristine and 5-fluorouracil, the family of agents known collectively LL-E33288 complex described in U.S. Pat. Nos. 5,053,394, 5,770,710, as well as esperamicins (U.S. Pat. No. 5,877,296).

Enzymatically active toxins and fragments thereof which can be used include diphtheria A chain, nonbinding active fragments of diphtheria toxin, exotoxin A chain (from *Pseudomonas aeruginosa*), ricin A chain, abrin A chain, modeccin A chain, alpha-sarcin, *Aleurites fordii* proteins, dianthin proteins, *Phytolaca americana* proteins (PAPI, PAPII, and PAP-S), *Momordica charantia* inhibitor, curcin, crotin, *Sapaonaria officinalis* inhibitor, gelonin, mitogellin, restrictocin, phenomycin, enomycin and the tricothecenes. See, for example, WO 93/21232 published Oct. 28, 1993.

The present invention further contemplates an ADC formed between an antibody and a compound with nucleolytic activity (e.g., a ribonuclease or a DNA endonuclease such as a deoxyribonuclease; DNase).

For selective destruction of the tumor, the antibody may comprise a highly radioactive atom. A variety of radioactive isotopes are available for the production of radioconjugated antibodies. Examples include At211, I131, I125, Y90, Re186, Re188, Sm153, Bi212, P32, Pb212 and radioactive isotopes of Lu.

The radio- or other labels may be incorporated in the conjugate in known ways. For example, the peptide may be biosynthesized or may be synthesized by chemical amino acid synthesis using suitable amino acid precursors involving, for example, fluorine-19 in place of hydrogen. Labels such as Tc99m or I123, Re186, Re188 and In111 can be attached via a cysteine residue in the peptide. Yttrium-90 can be attached via a lysine residue. The IODOGEN method (Fraker et al (1978) Biochem. Biophys. Res. Commun. 80: 49-57 can be used to incorporate Iodine-123. "Monoclonal Antibodies in Immunoscintigraphy" (Chatal, CRC Press 1989) describes other methods in detail.

For compositions comprising a plurality of antibodies, the drug loading is represented by p, the average number of drug molecules per Antibody. Drug loading may range from 1 to 20 drugs (D) per Antibody. The average number of drugs per antibody in preparation of conjugation reactions may be characterized by conventional means such as mass spectroscopy, ELISA assay, and HPLC. The quantitative distribution of Antibody-Drug-Conjugates in terms of p may also be determined.

In some instances, separation, purification, and characterization of homogeneous Antibody-Drug-conjugates where p is a certain value from Antibody-Drug-Conjugates with other drug loadings may be achieved by means such as reverse phase HPLC or electrophoresis. In exemplary embodiments, p is 2, 3, 4, 5, 6, 7, or 8 or a fraction thereof.

The generation of Antibody-drug conjugate compounds can be accomplished by any technique known to the skilled artisan. Briefly, the Antibody-drug conjugate compounds can include an pI antibody as the Antibody unit, a drug, and optionally a linker that joins the drug and the binding agent.

A number of different reactions are available for covalent attachment of drugs and/or linkers to binding agents. This is can be accomplished by reaction of the amino acid residues of the binding agent, for example, antibody molecule, including the amine groups of lysine, the free carboxylic acid groups of glutamic and aspartic acid, the sulfhydryl groups of cysteine and the various moieties of the aromatic amino acids. A commonly used non-specific methods of covalent attachment is the carbodiimide reaction to link a carboxy (or amino) group of a compound to amino (or carboxy) groups of the antibody. Additionally, bifunctional agents such as dialdehydes or imidoesters have been used to link the amino group of a compound to amino groups of an antibody molecule.

Also available for attachment of drugs to binding agents is the Schiff base reaction. This method involves the periodate oxidation of a drug that contains glycol or hydroxy groups, thus forming an aldehyde which is then reacted with the binding agent. Attachment occurs via formation of a Schiff base with amino groups of the binding agent. Isothiocyanates can also be used as coupling agents for covalently attaching drugs to binding agents. Other techniques are known to the skilled artisan and within the scope of the present invention.

In some embodiments, an intermediate, which is the precursor of the linker, is reacted with the drug under appropriate conditions. In other embodiments, reactive groups are used on the drug and/or the intermediate. The product of the reaction between the drug and the intermediate, or the derivatized drug, is subsequently reacted with an pI antibody of the invention under appropriate conditions.

It will be understood that chemical modifications may also be made to the desired compound in order to make reactions of that compound more convenient for purposes of preparing conjugates of the invention. For example a functional group e.g. amine, hydroxyl, or sulfhydryl, may be appended to the drug at a position which has minimal or an acceptable effect on the activity or other properties of the drug

VII. Linker Units

Typically, the antibody-drug conjugate compounds comprise a Linker unit between the drug unit and the antibody unit. In some embodiments, the linker is cleavable under intracellular or extracellular conditions, such that cleavage of the linker releases the drug unit from the antibody in the appropriate environment. For example, solid tumors that secrete certain proteases may serve as the target of the cleavable linker; in other embodiments, it is the intracellular proteases that are utilized. In yet other embodiments, the linker unit is not cleavable and the drug is released, for example, by antibody degradation in lysosomes.

In some embodiments, the linker is cleavable by a cleaving agent that is present in the intracellular environment (for example, within a lysosome or endosome or caveolea). The linker can be, for example, a peptidyl linker that is cleaved by an intracellular peptidase or protease enzyme, including, but not limited to, a lysosomal or endosomal protease. In some embodiments, the peptidyl linker is at least two amino acids long or at least three amino acids long or more.

Cleaving agents can include, without limitation, cathepsins B and D and plasmin, all of which are known to hydrolyze dipeptide drug derivatives resulting in the release of active drug inside target cells (see, e.g., Dubowchik and Walker, 1999, Pharm. Therapeutics 83:67-123). Peptidyl linkers that are cleavable by enzymes that are present in CD38-expressing cells. For example, a peptidyl linker that is cleavable by the thiol-dependent protease cathepsin-B, which is highly expressed in cancerous tissue, can be used (e.g., a Phe-Leu or a Gly-Phe-Leu-Gly linker (SEQ ID NO: X)). Other examples of such linkers are described, e.g., in U.S. Pat. No. 6,214,345, incorporated herein by reference in its entirety and for all purposes.

In some embodiments, the peptidyl linker cleavable by an intracellular protease is a Val-Cit linker or a Phe-Lys linker (see, e.g., U.S. Pat. No. 6,214,345, which describes the synthesis of doxorubicin with the val-cit linker).

In other embodiments, the cleavable linker is pH-sensitive, that is, sensitive to hydrolysis at certain pH values. Typically, the pH-sensitive linker hydrolyzable under acidic conditions. For example, an acid-labile linker that is hydrolyzable in the lysosome (for example, a hydrazone, semicarbazone, thiosemicarbazone, cis-aconitic amide, orthoester, acetal, ketal, or the like) may be used. (See, e.g., U.S. Pat. Nos. 5,122,368; 5,824,805; 5,622,929; Dubowchik and Walker, 1999, Pharm. Therapeutics 83:67-123; Neville et al., 1989, Biol. Chem. 264:14653-14661.) Such linkers are relatively stable under neutral pH conditions, such as those in the blood, but are unstable at below pH 5.5 or 5.0, the approximate pH of the lysosome. In certain embodiments, the hydrolyzable linker is a thioether linker (such as, e.g., a thioether attached to the therapeutic agent via an acylhydrazone bond (see, e.g., U.S. Pat. No. 5,622,929).

In yet other embodiments, the linker is cleavable under reducing conditions (for example, a disulfide linker). A variety of disulfide linkers are known in the art, including, for example, those that can be formed using SATA (N-succinimidyl-5-acetylthioacetate), SPDP (N-succinimidyl-3-(2-pyridyldithio)propionate), SPDB (N-succinimidyl-3-(2-pyridyldithio)butyrate) and SMPT (N-succinimidyl-oxycarbonyl-alpha-methyl-alpha-(2-pyridyl-dithio) toluene)-, SPDB and SMPT. (See, e.g., Thorpe et al., 1987, Cancer Res. 47:5924-5931; Wawrzynczak et al., In Immunoconjugates: Antibody Conjugates in Radioimagery and Therapy of Cancer (C. W. Vogel ed., Oxford U. Press, 1987. See also U.S. Pat. No. 4,880,935.)

In other embodiments, the linker is a malonate linker (Johnson et al., 1995, Anticancer Res. 15:1387-93), a maleimidobenzoyl linker (Lau et al., 1995, Bioorg-Med-Chem. 3(10):1299-1304), or a 3'-N-amide analog (Lau et al., 1995, Bioorg-Med-Chem. 3(10):1305-12).

In yet other embodiments, the linker unit is not cleavable and the drug is released by antibody degradation. (See U.S. Publication No. 2005/0238649 incorporated by reference herein in its entirety and for all purposes).

In many embodiments, the linker is self-immolative. As used herein, the term "self-immolative Spacer" refers to a bifunctional chemical moiety that is capable of covalently linking together two spaced chemical moieties into a stable tripartite molecule. It will spontaneously separate from the second chemical moiety if its bond to the first moiety is cleaved. See for example, WO 2007059404A2, WO06110476A2, WO05112919A2, WO2010/062171, WO09/017394, WO07/089149, WO 07/018431, WO04/043493 and WO02/083180, which are directed to drug-cleavable substrate conjugates where the drug and cleavable substrate are optionally linked through a self-immolative linker and which are all expressly incorporated by reference.

Often the linker is not substantially sensitive to the extracellular environment. As used herein, "not substantially sensitive to the extracellular environment," in the context of a linker, means that no more than about 20%, 15%, 10%, 5%, 3%, or no more than about 1% of the linkers, in a sample of antibody-drug conjugate compound, are cleaved when the antibody-drug conjugate compound presents in an extracellular environment (for example, in plasma).

Whether a linker is not substantially sensitive to the extracellular environment can be determined, for example, by incubating with plasma the antibody-drug conjugate compound for a predetermined time period (for example, 2, 4, 8, 16, or 24 hours) and then quantitating the amount of free drug present in the plasma.

In other, non-mutually exclusive embodiments, the linker promotes cellular internalization. In certain embodiments, the linker promotes cellular internalization when conjugated to the therapeutic agent (that is, in the milieu of the linker-therapeutic agent moiety of the antibody-drug conjugate compound as described herein). In yet other embodiments, the linker promotes cellular internalization when conjugated to both the auristatin compound and the pI antibodies of the invention.

A variety of exemplary linkers that can be used with the present compositions and methods are described in WO 2004-010957, U.S. Publication No. 2006/0074008, U.S. Publication No. 20050238649, and U.S. Publication No. 2006/0024317 (each of which is incorporated by reference herein in its entirety and for all purposes).

VIII. Drug Loading

Drug loading is represented by p and is the average number of Drug moieties per antibody in a molecule. Drug loading ("p") may be 1, 2, 3, 4, 5, 6, 7, 8, 9, 10, 11, 12, 13, 14, 15, 16, 17, 18, 19, 20 or more moieties (D) per antibody, although frequently the average number is a fraction or a decimal. Generally, drug loading of from 1 to 4 is frequently useful, and from 1 to 2 is also useful. ADCs of the invention include collections of antibodies conjugated with a range of drug moieties, from 1 to 20. The average number of drug moieties per antibody in preparations of ADC from conjugation reactions may be characterized by conventional means such as mass spectroscopy and, ELISA assay.

The quantitative distribution of ADC in terms of p may also be determined. In some instances, separation, purification, and characterization of homogeneous ADC where p is a certain value from ADC with other drug loadings may be achieved by means such as electrophoresis.

For some antibody-drug conjugates, p may be limited by the number of attachment sites on the antibody. For example, where the attachment is a cysteine thiol, as in the exemplary embodiments above, an antibody may have only one or several cysteine thiol groups, or may have only one or several sufficiently reactive thiol groups through which a linker may be attached. In certain embodiments, higher drug loading, e.g. p>5, may cause aggregation, insolubility, toxicity, or loss of cellular permeability of certain antibody-drug conjugates. In certain embodiments, the drug loading for an ADC of the invention ranges from 1 to about 8; from about 2 to about 6; from about 3 to about 5; from about 3 to about 4; from about 3.1 to about 3.9; from about 3.2 to about 3.8; from about 3.2 to about 3.7; from about 3.2 to about 3.6; from about 3.3 to about 3.8; or from about 3.3 to about 3.7. Indeed, it has been shown that for certain ADCs, the optimal ratio of drug moieties per antibody may be less than 8, and may be about 2 to about 5. See US 2005-0238649 A1 (herein incorporated by reference in its entirety).

In certain embodiments, fewer than the theoretical maximum of drug moieties are conjugated to an antibody during a conjugation reaction. An antibody may contain, for example, lysine residues that do not react with the drug-linker intermediate or linker reagent, as discussed below. Generally, antibodies do not contain many free and reactive cysteine thiol groups which may be linked to a drug moiety; indeed most cysteine thiol residues in antibodies exist as disulfide bridges. In certain embodiments, an antibody may be reduced with a reducing agent such as dithiothreitol (DTT) or tricarbonylethylphosphine (TCEP), under partial or total reducing conditions, to generate reactive cysteine thiol groups. In certain embodiments, an antibody is subjected to denaturing conditions to reveal reactive nucleophilic groups such as lysine or cysteine.

The loading (drug/antibody ratio) of an ADC may be controlled in different ways, e.g., by: (i) limiting the molar excess of drug-linker intermediate or linker reagent relative to antibody, (ii) limiting the conjugation reaction time or temperature, (iii) partial or limiting reductive conditions for cysteine thiol modification, (iv) engineering by recombinant techniques the amino acid sequence of the antibody such that the number and position of cysteine residues is modified for control of the number and/or position of linker-drug attachments (such as THIOMAB®, antibodies with an engineered unpaired cysteine residue, or thioFab prepared as disclosed herein and in WO2006/034488 (herein incorporated by reference in its entirety)).

It is to be understood that where more than one nucleophilic group reacts with a drug-linker intermediate or linker reagent followed by drug moiety reagent, then the resulting product is a mixture of ADC compounds with a distribution of one or more drug moieties attached to an antibody. The average number of drugs per antibody may be calculated from the mixture by a dual ELISA antibody assay, which is specific for antibody and specific for the drug. Individual ADC molecules may be identified in the mixture by mass spectroscopy and separated by HPLC, e.g. hydrophobic interaction chromatography.

In some embodiments, a homogeneous ADC with a single loading value may be isolated from the conjugation mixture by electrophoresis or chromatography.

Methods of Determining Cytotoxic Effect of ADCs

Methods of determining whether a Drug or Antibody-Drug conjugate exerts a cytostatic and/or cytotoxic effect on a cell are known. Generally, the cytotoxic or cytostatic activity of an Antibody Drug conjugate can be measured by: exposing mammalian cells expressing a target protein of the Antibody Drug conjugate in a cell culture medium; culturing the cells for a period from about 6 hours to about 5 days; and measuring cell viability. Cell-based in vitro assays can be used to measure viability (proliferation), cytotoxicity, and induction of apoptosis (caspase activation) of the Antibody Drug conjugate.

For determining whether an Antibody Drug conjugate exerts a cytostatic effect, a thymidine incorporation assay may be used. For example, cancer cells expressing a target antigen at a density of 5,000 cells/well of a 96-well plated can be cultured for a 72-hour period and exposed to 0.5 µCi of $^3$H-thymidine during the final 8 hours of the 72-hour period. The incorporation of $^3$H-thymidine into cells of the culture is measured in the presence and absence of the Antibody Drug conjugate.

For determining cytotoxicity, necrosis or apoptosis (programmed cell death) can be measured. Necrosis is typically accompanied by increased permeability of the plasma membrane; swelling of the cell, and rupture of the plasma membrane. Apoptosis is typically characterized by membrane blebbing, condensation of cytoplasm, and the activation of endogenous endonucleases. Determination of any of these effects on cancer cells indicates that an Antibody Drug conjugate is useful in the treatment of cancers.

Cell viability can be measured by determining in a cell the uptake of a dye such as neutral red, trypan blue, or ALAMAR™ blue (see, e.g., Page et al., 1993, Intl. J. Oncology 3:473-476). In such an assay, the cells are incubated in media containing the dye, the cells are washed, and the remaining dye, reflecting cellular uptake of the dye, is measured spectrophotometrically. The protein-binding dye sulforhodamine B (SRB) can also be used to measure cytoxicity (Skehan et al., 1990, J. Natl. Cancer Inst. 82:1107-12).

Alternatively, a tetrazolium salt, such as MTT, is used in a quantitative colorimetric assay for mammalian cell survival and proliferation by detecting living, but not dead, cells (see, e.g., Mosmann, 1983, J. Immunol. Methods 65:55-63).

Apoptosis can be quantitated by measuring, for example, DNA fragmentation. Commercial photometric methods for the quantitative in vitro determination of DNA fragmentation are available. Examples of such assays, including TUNEL (which detects incorporation of labeled nucleotides in fragmented DNA) and ELISA-based assays, are described in Biochemica, 1999, no. 2, pp. 34-37 (Roche Molecular Biochemicals).

Apoptosis can also be determined by measuring morphological changes in a cell. For example, as with necrosis, loss of plasma membrane integrity can be determined by measuring uptake of certain dyes (e.g., a fluorescent dye such as, for example, acridine orange or ethidium bromide). A method for measuring apoptotic cell number has been described by Duke and Cohen, Current Protocols in Immunology (Coligan et al. eds., 1992, pp. 3.17.1-3.17.16). Cells also can be labeled with a DNA dye (e.g., acridine orange, ethidium bromide, or propidium iodide) and the cells observed for chromatin condensation and margination along the inner nuclear membrane. Other morphological changes that can be measured to determine apoptosis include, e.g., cytoplasmic condensation, increased membrane blebbing, and cellular shrinkage.

The presence of apoptotic cells can be measured in both the attached and "floating" compartments of the cultures. For example, both compartments can be collected by removing the supernatant, trypsinizing the attached cells, combining the preparations following a centrifugation wash step (e.g., 10 minutes at 2000 rpm), and detecting apoptosis (e.g., by measuring DNA fragmentation). (See, e.g., Piazza et al., 1995, Cancer Research 55:3110-16).

In vivo, the effect of a therapeutic composition of the pI antibody of the invention can be evaluated in a suitable animal model. For example, xenogenic cancer models can be used, wherein cancer explants or passaged xenograft tissues are introduced into immune compromised animals, such as nude or SCID mice (Klein et al., 1997, Nature Medicine 3: 402-408). Efficacy can be measured using assays that measure inhibition of tumor formation, tumor regression or metastasis, and the like.

The therapeutic compositions used in the practice of the foregoing methods can be formulated into pharmaceutical compositions comprising a carrier suitable for the desired delivery method. Suitable carriers include any material that when combined with the therapeutic composition retains the anti-tumor function of the therapeutic composition and is generally non-reactive with the patient's immune system. Examples include, but are not limited to, any of a number of standard pharmaceutical carriers such as sterile phosphate buffered saline solutions, bacteriostatic water, and the like (see, generally, Remington's Pharmaceutical Sciences 16$^{th}$ Edition, A. Osal., Ed., 1980).

Glycosylation

Another type of covalent modification is alterations in glycosylation. In another embodiment, the antibodies disclosed herein can be modified to include one or more engineered glycoforms. By "engineered glycoform" as used herein is meant a carbohydrate composition that is covalently attached to the antibody, wherein said carbohydrate composition differs chemically from that of a parent antibody. Engineered glycoforms may be useful for a variety of purposes, including but not limited to enhancing or reducing effector function. A preferred form of engineered glycoform is afucosylation, which has been shown to be correlated to an increase in ADCC function, presumably through tighter binding to the FcγRIIIa receptor. In this context, "afucosylation" means that the majority of the antibody produced in the host cells is substantially devoid of fucose, e.g. 90-95-98% of the generated antibodies do not have appreciable fucose as a component of the carbohydrate moiety of the antibody (generally attached at N297 in the Fc region). Defined functionally, afucosylated antibodies generally exhibit at least a 50% or higher affinity to the FcγRIIIa receptor.

Engineered glycoforms may be generated by a variety of methods known in the art (Umaña et al., 1999, Nat Biotechnol 17:176-180; Davies et al., 2001, Biotechnol Bioeng 74:288-294; Shields et al., 2002, J Biol Chem 277:26733-26740; Shinkawa et al., 2003, J Biol Chem 278:3466-3473; U.S. Pat. No. 6,602,684; U.S. Ser. No. 10/277,370; U.S. Ser. No. 10/113,929; PCT WO 00/61739A1; PCT WO 01/29246A1; PCT WO 02/31140A1; PCT WO 02/30954A1, all entirely incorporated by reference; (POTELLIGENT® host cell line for the production of recombinant antibodies technology [Biowa, Inc., Princeton, N.J.]; GLYCOMAB® glycosylation engineering technology [Glycart Biotechnology AG, Zurich, Switzerland]). Many of these techniques are based on controlling the level of fucosylated and/or bisecting oligosaccharides that are covalently attached to the Fc region, for example by expressing an IgG in various organisms or cell lines, engineered or otherwise (for example Lec-13 CHO cells or rat hybridoma YB2/0 cells, by regulating enzymes involved in the glycosylation pathway (for example FUT8 [α1,6-fucosyltranserase] and/or R1-4-N-acetylglucosaminyltransferase III [GnTIII]), or by modifying carbohydrate(s) after the IgG has been expressed. For example, the "sugar engineered antibody" or "SEA technology" of Seattle Genetics functions by adding modified saccharides that inhibit fucosylation during production; see for example 20090317869, hereby incorporated by reference in its entirety. Engineered glycoform typically refers to the different carbohydrate or oligosaccharide; thus an antibody can include an engineered glycoform.

Alternatively, engineered glycoform may refer to the IgG variant that comprises the different carbohydrate or oligosaccharide. As is known in the art, glycosylation patterns can depend on both the sequence of the protein (e.g., the presence or absence of particular glycosylation amino acid residues, discussed below), or the host cell or organism in which the protein is produced. Particular expression systems are discussed below.

Glycosylation of polypeptides is typically either N-linked or O-linked. N-linked refers to the attachment of the carbohydrate moiety to the side chain of an asparagine residue. The tri-peptide sequences asparagine-X-serine and asparagine-X-threonine, where X is any amino acid except proline, are the recognition sequences for enzymatic attachment of the carbohydrate moiety to the asparagine side chain. Thus, the presence of either of these tri-peptide sequences in a polypeptide creates a potential glycosylation site. O-linked glycosylation refers to the attachment of one of the sugars N-acetylgalactosamine, galactose, or xylose, to a hydroxyamino acid, most commonly serine or threonine, although 5-hydroxyproline or 5-hydroxylysine may also be used.

Addition of glycosylation sites to the antibody is conveniently accomplished by altering the amino acid sequence such that it contains one or more of the above-described tri-peptide sequences (for N-linked glycosylation sites). The alteration may also be made by the addition of, or substitution by, one or more serine or threonine residues to the starting sequence (for O-linked glycosylation sites). For ease, the antibody amino acid sequence is preferably altered through changes at the DNA level, particularly by mutating the DNA encoding the target polypeptide at preselected bases such that codons are generated that will translate into the desired amino acids.

Another means of increasing the number of carbohydrate moieties on the antibody is by chemical or enzymatic coupling of glycosides to the protein. These procedures are advantageous in that they do not require production of the protein in a host cell that has glycosylation capabilities for N- and O-linked glycosylation. Depending on the coupling mode used, the sugar(s) may be attached to (a) arginine and histidine, (b) free carboxyl groups, (c) free sulfhydryl groups such as those of cysteine, (d) free hydroxyl groups such as those of serine, threonine, or hydroxyproline, (e) aromatic residues such as those of phenylalanine, tyrosine, or tryptophan, or (f) the amide group of glutamine. These methods are described in WO 87/05330 and in Aplin and Wriston, 1981, CRC Crit. Rev. Biochem., pp. 259-306, both entirely incorporated by reference.

Removal of carbohydrate moieties present on the starting antibody (e.g. post-translationally) may be accomplished chemically or enzymatically. Chemical deglycosylation requires exposure of the protein to the compound trifluoromethanesulfonic acid, or an equivalent compound. This treatment results in the cleavage of most or all sugars except the linking sugar (N-acetylglucosamine or N-acetylgalactosamine), while leaving the polypeptide intact. Chemical deglycosylation is described by Hakimuddin et al., 1987, Arch. Biochem. Biophys. 259:52 and by Edge et al., 1981, Anal. Biochem. 118:131, both entirely incorporated by reference. Enzymatic cleavage of carbohydrate moieties on polypeptides can be achieved by the use of a variety of endo- and exo-glycosidases as described by Thotakura et al., 1987, Meth. Enzymol. 138:350, entirely incorporated by reference. Glycosylation at potential glycosylation sites may be prevented by the use of the compound tunicamycin as described by Duskin et al., 1982, J. Biol. Chem. 257:3105, entirely incorporated by reference. Tunicamycin blocks the formation of protein-N-glycoside linkages.

Another type of covalent modification of the antibody comprises linking the antibody to various nonproteinaceous polymers, including, but not limited to, various polyols such as polyethylene glycol, polypropylene glycol or polyoxyalkylenes, in the manner set forth in, for example, 2005-2006 PEG Catalog from Nektar Therapeutics (available at the Nektar website) U.S. Pat. Nos. 4,640,835; 4,496,689; 4,301,144; 4,670,417; 4,791,192 or 4,179,337, all entirely incorporated by reference. In addition, as is known in the art, amino acid substitutions may be made in various positions within the antibody to facilitate the addition of polymers such as PEG. See for example, U.S. Publication No. 2005/0114037A1, entirely incorporated by reference.

Nucleic Acids and Host Cells

Included within the invention are the nucleic acids encoding the pI antibodies of the invention. In the case where both a heavy and light chain constant domains are included in the pI antibody, generally these are made using nucleic acids encoding each, that are combined into standard host cells (e.g. CHO cells, etc.) to produce the tetrameric structure of the antibody. If only one pI engineered constant domain is being made, only a single nucleic acid will be used.

Targets

As will be appreciated by those in the art, a wide variant of antigen binding domains, e.g. Fv regions, may find use in the present invention. Virtually any antigen may be targeted by the IgG variants, including but not limited to proteins, subunits, domains, motifs, and/or epitopes belonging to the following list of target antigens, which includes both soluble factors such as cytokines and membrane-bound factors, including transmembrane receptors: 17-IA, 4-1BB, 4Dc, 6-keto-PGF1a, 8-iso-PGF2a, 8-oxo-dG, A1 Adenosine Receptor, A33, ACE, ACE-2, Activin, Activin A, Activin AB, Activin B, Activin C, Activin RIA, Activin RIA ALK-2, Activin RIB ALK-4, Activin RIIA, Activin RIIB, ADAM, ADAM10, ADAM12, ADAM15, ADAM17/TACE, ADAM8, ADAM9, ADAMTS, ADAMTS4, ADAMTS5, Addressins, aFGF, ALCAM, ALK, ALK-1, ALK-7, alpha-1-antitrypsin, alpha-V/beta-1 antagonist, ANG, Ang, APAF-1, APE, APJ, APP, APRIL, AR, ARC, ART, Artemin, anti-Id, ASPARTIC, Atrial natriuretic factor, av/b3 integrin, Axl, b2M, B7-1, B7-2, B7-H, B-lymphocyte Stimulator (BlyS), BACE, BACE-1, Bad, BAFF, BAFF-R, Bag-1, BAK, Bax, BCA-1, BCAM, Bcl, BCMA, BDNF, b-ECGF, bFGF, BID, Bik, BIM, BLC, BL-CAM, BLK, BMP, BMP-2 BMP-2a, BMP-3 Osteogenin, BMP-4 BMP-2b, BMP-5, BMP-6 Vgr-1, BMP-7 (OP-1), BMP-8 (BMP-8a, OP-2), BMPR, BMPR-IA (ALK-3), BMPR-IB (ALK-6), BRK-2, RPK-1, BMPR-II (BRK-3), BMPs, b-NGF, BOK, Bombesin, Bone-derived neurotrophic factor, BPDE, BPDE-DNA, BTC, complement factor 3(C3), C3a, C4, C5, C5a, C10, CA125, CAD-8, Calcitonin, cAMP, carcinoembryonic antigen (CEA), carcinoma-associated antigen, Cathepsin A, Cathepsin B, Cathepsin C/DPPI, Cathepsin D, Cathepsin E, Cathepsin H, Cathepsin L, Cathepsin 0, Cathepsin S, Cathepsin V, Cathepsin X/Z/P, CBL, CCI, CCK2, CCL, CCL1, CCL11, CCL12, CCL13, CCL14, CCL15, CCL16, CCL17, CCL18, CCL19, CCL2, CCL20, CCL21, CCL22, CCL23, CCL24, CCL25, CCL26, CCL27, CCL28, CCL3, CCL4, CCL5, CCL6, CCL7, CCL8, CCL9/10, CCR, CCR1, CCR10, CCR10, CCR2, CCR3, CCR4, CCR5, CCR6, CCR7, CCR8, CCR9, CD1, CD2, CD3, CD3E, CD4, CD5, CD6, CD7, CD8, CD10, CD11a, CD11b, CD11c, CD13, CD14, CD15, CD16, CD18, CD19, CD20, CD21, CD22, CD23, CD25, CD27L, CD28, CD29, CD30, CD30L, CD32, CD33 (p67 proteins), CD34, CD38, CD40, CD40L, CD44, CD45, CD46, CD49a, CD52, CD54, CD55, CD56, CD61, CD64, CD66e, CD74, CD80 (B7-1), CD89, CD95, CD123, CD137, CD138, CD140a, CD146, CD147, CD148, CD152, CD164, CEACAM5, CFTR, cGMP, CINC, *Clostridium botulinum* toxin, *Clostridium perfringens* toxin, CKb8-1, CLC, CMV, CMV UL, CNTF, CNTN-1, COX, C-Ret, CRG-2, CT-1, CTACK, CTGF, CTLA-4, CX3CL1, CX3CR1, CXCL, CXCL1, CXCL2, CXCL3, CXCL4, CXCL5, CXCL6, CXCL7, CXCL8, CXCL9, CXCL10, CXCL11, CXCL12, CXCL13, CXCL14, CXCL15, CXCL16, CXCR, CXCR1, CXCR2, CXCR3, CXCR4, CXCR5, CXCR6, cytokeratin tumor-associated antigen, DAN, DCC, DcR3, DC-SIGN, Decay accelerating factor, des(1-3)-IGF-I (brain IGF-1), Dhh, digoxin, DNAM-1, Dnase, Dpp, DPPIV/CD26, Dtk, ECAD, EDA, EDA-A1, EDA-A2, EDAR, EGF, EGFR (ErbB-1), EMA, EMMPRIN, ENA, endothelin receptor, Enkephalinase, eNOS, Eot, eotaxin, EpCAM, Ephrin B2/EphB4, EPO, ERCC, E-selectin, ET-1, Factor IIa, Factor VII, Factor VIIIc, Factor IX, fibroblast activation protein (FAP), Fas, FcR1, FEN-1, Ferritin, FGF, FGF-19, FGF-2, FGF3, FGF-8, FGFR, FGFR-3, Fibrin, FL, FLIP, Flt-3, Flt-4, Follicle stimulating hormone, Fractalkine, FZD1, FZD2, FZD3, FZD4, FZD5, FZD6, FZD7, FZD8, FZD9, FZD10, G250, Gas 6, GCP-2, GCSF, GD2, GD3, GDF, GDF-1, GDF-3 (Vgr-2), GDF-5 (BMP-14, CDMP-1), GDF-6 (BMP-13, CDMP-2), GDF-7 (BMP-12, CDMP-3), GDF-8 (Myostatin), GDF-9, GDF-15 (MIC-1), GDNF, GDNF, GFAP, GFRa-1, GFR-alpha1, GFR-alpha2, GFR-alpha3, GITR, Glucagon, Glut 4, glycoprotein IIb/IIIa (GP IIb/IIIa), GM-CSF, gp130, gp72, GRO, Growth hormone releasing factor, Hapten (NP-cap or NIP-cap), HB-EGF, HCC, HCMV gB envelope glycoprotein, HCMV) gH envelope glycoprotein, HCMV UL, Hemopoietic growth factor (HGF), Hep B gp120, heparanase, Her2, Her2/neu (ErbB-2), Her3 (ErbB-3), Her4 (ErbB-4), herpes simplex virus (HSV) gB glycoprotein, HSV gD glycoprotein, HGFA, High molecular weight melanoma-associated antigen (HMW-MAA), HIV gp120, HIV IIIB gp 120 V3 loop, HLA, HLA-DR, HM1.24, HMFG PEM, HRG, Hrk, human cardiac myosin, human cytomegalovirus (HCMV), human growth hormone (HGH), HVEM, I-309, IAP, ICAM, ICAM-1, ICAM-3, ICE, ICOS, IFNg, Ig, IgA receptor, IgE, IGF, IGF binding proteins, IGF-1R, IGFBP, IGF-I, IGF-II, IL, IL-1, IL-1R, IL-2, IL-2R, IL-4, IL-4R, IL-5, IL-5R, IL-6, IL-6R, IL-8, IL-9, IL-10, IL-12, IL-13, IL-15, IL-18, IL-18R, IL-23, interferon (INF)-alpha, INF-beta, INF-gamma, Inhibin, iNOS, Insulin A-chain, Insulin B-chain, Insulin-like growth factor 1, integrin alpha2, integrin alpha3, integrin alpha4, integrin alpha4/beta1, integrin alpha4/beta7, integrin alpha5 (alphaV), integrin alpha5/beta1, integrin alpha5/beta3, integrin alpha6, integrin beta1, integrin beta2, interferon gamma, IP-10, I-TAC, JE, Kallikrein 2, Kallikrein 5, Kallikrein 6, Kallikrein 11, Kallikrein 12, Kallikrein 14, Kallikrein 15, Kallikrein L1, Kallikrein L2, Kallikrein L3, Kallikrein L4, KC, KDR, Keratinocyte Growth Factor (KGF), laminin 5, LAMP, LAP, LAP (TGF-1), Latent TGF-1, Latent TGF-1 bp, LBP, LDGF, LECT2, Lefty, Lewis-Y antigen, Lewis-Y related antigen, LFA-1, LFA-3, Lfo, LIF, LIGHT, lipoproteins, LIX, LKN, Lptn, L-Selectin, LT-a, LT-b, LTB4, LTBP-1, Lung surfactant, Luteinizing hormone, Lymphotoxin Beta Receptor, Mac-1, MAdCAM, MAG, MAP2, MARC, MCAM, MCAM, MCK-2, MCP, M-CSF, MDC, Mer, METALLOPROTEASES, MGDF receptor, MGMT, MHC (HLA-DR), MIF, MIG, MIP, MIP-1-alpha, MK, MMAC1, MMP, MMP-1, MMP-10, MMP-11, MMP-12, MMP-13, MMP-14, MMP-15, MMP-2, MMP-24, MMP-3, MMP-7, MMP-8, MMP-9, MPIF, Mpo, MSK, MSP, mucin (Muc1), MUC18, Muellerian-inhibitin substance, Mug, MuSK, NAIP, NAP, NCAD, N-Cadherin, NCA 90, NCAM, NCAM, Neprilysin, Neurotrophin-3, -4, or -6, Neurturin, Neuronal growth factor (NGF), NGFR, NGF-beta, nNOS, NO, NOS, Npn, NRG-3, NT, NTN, OB, OGG1, OPG, OPN, OSM, OX40L, OX40R, p150, p95, PADPr, Parathyroid hormone, PARC, PARP, PBR, PBSF, PCAD, P-Cadherin, PCNA, PDGF, PDGF, PDK-1, PECAM, PEM, PF4, PGE, PGF, PGI2, PGJ2, PIN, PLA2, placental alkaline phosphatase (PLAP), P1GF, PLP, PP14, Proinsulin, Prorelaxin, Protein C, PS, PSA, PSCA, prostate specific membrane antigen (PSMA), PTEN, PTHrp, Ptk, PTN, R51, RANK, RANKL, RANTES, RANTES, Relaxin A-chain, Relaxin B-chain, renin, respiratory syncytial virus (RSV) F, RSV Fgp, Ret, Rheumatoid factors, RLIP76, RPA2, RSK, S100, SCF/KL, SDF-1, SERINE, Serum albumin, sFRP-3, Shh, SIGIRR, SK-1, SLAM, SLPI, SMAC, SMDF, SMOH, SOD, SPARC, Stat, STEAP, STEAP-II, TACE, TACI, TAG-72 (tumor-associated glycoprotein-72), TARC, TCA-3, T-cell receptors (e.g., T-cell receptor alpha/beta), TdT, TECK, TEM1, TEM5, TEM7, TEM8, TERT, testicular PLAP-like alkaline phosphatase, TfR, TGF, TGF-alpha, TGF-beta, TGF-beta Pan Specific, TGF-beta RI (ALK-5), TGF-beta RII, TGF-beta RIIb, TGF-beta RIII, TGF-beta1, TGF-beta2, TGF-beta3, TGF-beta4, TGF-beta5, Thrombin, Thymus Ck-1, Thyroid stimulating hormone, Tie, TIMP, TIQ, Tissue Factor, TMEFF2, Tmpo, TMPRSS2, TNF, TNF-alpha, TNF-alpha beta, TNF-beta2, TNFc, TNF-RI, TNF-RII, TNFRSF10A (TRAIL R1 Apo-2, DR4), TNFRSF10B (TRAIL R2 DR5, KILLER, TRICK-2A, TRICK-B), TNFRSF10C (TRAIL R3 DcR1, LIT, TRID), TNFRSF10D (TRAIL R4 DcR2, TRUNDD), TNFRSF11A (RANK ODF R, TRANCE R), TNFRSF11B (OPG OCIF, TR1), TNFRSF12 (TWEAK R FN14), TNFRSF13B (TACI), TNFRSF13C (BAFF R), TNFRSF14 (HVEM ATAR, HveA, LIGHT R, TR2), TNFRSF16 (NGFR p75NTR), TNFRSF17 (BCMA), TNFRSF18 (GITR AITR), TNFRSF19 (TROY TAJ, TRADE), TNFRSF19L (RELT), TNFRSF1A (TNF RI CD120a, p55-60), TNFRSF1B (TNF RII CD120b, p75-80), TNFRSF26 (TNFRH3), TNFRSF3 (LTbR TNF RIII, TNFC R), TNFRSF4 (OX40 ACT35, TXGP1 R), TNFRSF5 (CD40 p50), TNFRSF6 (Fas Apo-1, APT1, CD95), TNFRSF6B (DcR3 M68, TR6), TNFRSF7 (CD27), TNFRSF8 (CD30), TNFRSF9 (4-1BB CD137, ILA), TNFRSF21 (DR6), TNFRSF22 (DcTRAIL R2 TNFRH2), TNFRST23 (DcTRAIL RI TNFRH1), TNFRSF25 (DR3 Apo-3, LARD, TR-3, TRAMP, WSL-1), TNFSF10 (TRAIL Apo-2 Ligand, TL2), TNFSF11 (TRANCE/RANK Ligand ODF, OPG Ligand), TNFSF12 (TWEAK Apo-3 Ligand, DR3 Ligand), TNFSF13 (APRIL TALL2), TNFSF13B (BAFF BLYS, TALL1, THANK, TNFSF20), TNFSF14 (LIGHT HVEM Ligand, LTg), TNFSF15 (TL1A/VEGI), TNFSF18 (GITR Ligand AITR Ligand, TL6), TNFSFA (TNF-α Conectin, DIF, TNFSF2), TNFSF1B (TNF-b LTa, TNFSF1), TNFSF3 (LTb TNFC, p33), TNFSF4 (OX40 Ligand gp34, TXGP1), TNFSF5 (CD40 Ligand CD154, gp39, HIGM1, IMD3, TRAP), TNFSF6 (Fas Ligand Apo-1 Ligand, APT1 Ligand), TNFSF7 (CD27 Ligand CD70), TNFSF8 (CD30 Ligand CD153), TNFSF9 (4-1BB Ligand CD137 Ligand), TP-1, t-PA, Tpo, TRAIL, TRAIL R, TRAIL-R1, TRAIL-R2, TRANCE, transferring receptor, TRF, Trk, TROP-2, TSG, TSLP, tumor-associated antigen CA 125, tumor-associated antigen expressing Lewis Y related carbohydrate, TWEAK, TXB2, Ung, uPAR, uPAR-1, Urokinase, VCAM, VCAM-1, VECAD, VE-Cadherin, VE-cadherin-2, VEFGR-1 (flt-1), VEGF, VEGFR, VEGFR-3 (flt-4), VEGI, VIM, Viral antigens, VLA, VLA-1, VLA-4, VNR integrin, von Willebrands factor, WIF-1, WNT1, WNT2, WNT2B/13, WNT3, WNT3A, WNT4, WNT5A, WNT5B, WNT6, WNT7A, WNT7B, WNT8A, WNT8B, WNT9A, WNT9A, WNT9B, WNT10A, WNT10B, WNT11, WNT16, XCL1, XCL2, XCR1, XCR1, XEDAR, XIAP, XPD, and receptors for hormones and growth factors.

Antibodies for Engineering

In some embodiments, the pI engineering described herein is done to therapeutic antibodies. A number of antibodies that are approved for use, in clinical trials, or in development may benefit from the pI variants of the present invention. These antibodies are herein referred to as "clinical products and candidates". Thus in a preferred embodiment, the pI engineered constant region(s) of the present invention may find use in a range of clinical products and candidates. For example, a number of antibodies that target CD20 may benefit from the pI engineering of the present invention. For example the pI variants of the present invention may find use in an antibody that is substantially similar to rituximab (RITUXAN®, IDEC/Genentech/Roche) (see for example U.S. Pat. No. 5,736,137), a chimeric anti-CD20 antibody approved to treat Non-Hodgkin's lymphoma; HUMAX®-CD20, an anti-CD20 antibody currently being developed by Genmab, an anti-CD20 antibody described in U.S. Pat. No. 5,500,362; AME-133 (Applied Molecular Evolution), hA20 (Immunomedics, Inc.), HumaLYM™ (INTRACEL®; an anti-CD20 antibody), and PR070769 (PCT/US2003/040426, entitled "Immunoglobulin Variants and Uses Thereof"). A number of antibodies that target members of the family of epidermal growth factor receptors, including EGFR (ErbB-1), Her2/neu (ErbB-2), Her3 (ErbB-3), Her4 (ErbB-4), may benefit from pI engineered constant region(s) of the invention. For example the pI engineered constant region(s) of the invention may find use in an antibody that is substantially similar to trastuzumab (HERCEPTIN®, Genentech) (see for example U.S. Pat. No. 5,677,171), a humanized anti-Her2/neu antibody approved to treat breast cancer; pertuzumab (rhuMab-2C4, OMNITARG™), currently being developed by Genentech; an anti-Her2 antibody described in U.S. Pat. No. 4,753,894; cetuximab (ERBITUX®, Imclone) (U.S. Pat. No. 4,943,533; PCT WO 96/40210), a chimeric anti-EGFR antibody in clinical trials for a variety of cancers; ABX-EGF (U.S. Pat. No. 6,235,883), currently being developed by Abgenix-Immunex-Amgen; HUMAX®-EGFr (U.S. Ser. No. 10/172,317), zalutumumab currently being developed by Genmab; 425, EMD55900, EMD62000, and EMD72000 (Merck KGaA) (U.S. Pat. No. 5,558,864; Murthy et al. 1987, Arch Biochem Biophys. 252(2):549-60; Rodeck et al., 1987, J Cell Biochem. 35(4):315-20; Kettleborough et al., 1991, Protein Eng. 4(7):773-83); ICR62 (Institute of Cancer Research) (PCT WO 95/20045; Modjtahedi et al., 1993, J. Cell Biophys. 1993, 22(1-3):129-46; Modjtahedi et al., 1993, Br J Cancer. 1993, 67(2):247-53; Modjtahedi et al, 1996, Br J Cancer, 73(2):228-35; Modjtahedi et al, 2003, Int J Cancer, 105(2):273-80); TheraCIM hR3 (YM Biosciences, Canada and Centro de Immunologia Molecular, Cuba (U.S. Pat. Nos. 5,891,996; 6,506,883; Mateo et al, 1997, Immunotechnology, 3(1):71-81); mAb-806 (Ludwig Institue for Cancer Research, Memorial Sloan-Kettering) (Jungbluth et al. 2003, Proc Natl Acad Sci USA. 100(2):639-44); KSB-102 (KS Biomedix); MR1-1 (IVAX, National Cancer Institute) (PCT WO 0162931A2); and SC100 (Scancell) (PCT WO 01/88138). In another preferred embodiment, the pI engineered constant region(s) of the present invention may find use in alemtuzumab (CAMPATH®, Millenium), a humanized monoclonal antibody currently approved for treatment of B-cell chronic lymphocytic leukemia. The pI engineered constant region(s) of the present invention may find use in a variety of antibodies that are substantially similar to other clinical products and candidates, including but not limited to muromonab-CD3 (ORTHOCLONE OKT3®), an anti-CD3 antibody developed by Ortho Biotech/Johnson & Johnson, ibritumomab tiuxetan (ZEVALIN®), an anti-CD20 antibody developed by IDEC/Schering AG, gemtuzumab ozogamicin (MYLOTARG®), an anti-CD33 (p67 protein) antibody developed by Celltech/Wyeth, alefacept (AMEVIVE®), an anti-LFA-3 Fc fusion developed by Biogen), abciximab (REOPRO®), developed by Centocor/Lilly, basiliximab (SIMULECT®), developed by Novartis, palivizumab (SYNAGIS®), developed by MedImmune, infliximab (REMICADE®), an anti-TNFalpha antibody developed by Centocor, adalimumab (HUMIRA®), an anti-TNFalpha antibody developed by Abbott, HUMICADE™, an anti-TNFalpha antibody developed by Celltech, etanercept (ENBREL®), an anti-TNFalpha Fc fusion developed by Immunex/Amgen, ABX-CBL, an anti-CD147 antibody being developed by Abgenix, ABX-IL8, an anti-IL8 antibody being developed by Abgenix, ABX-MA1, an anti-MUC18 antibody being developed by Abgenix, Pemtumomab (R1549, 90Y-muHMFGI), an anti-MUC1 In development by Antisoma, THEREX™ (R1550), an anti-MUC1 antibody being developed by Antisoma, ANGIOMAB™ (AS1405), being developed by Antisoma, HuBC-1, being developed by Antisoma, THIOPLATIN™ (AS1407) being developed by Antisoma, ANTEGREN® (natalizumab), an anti-alpha-4-beta-1 (VLA-4) and alpha-4-beta-7 antibody being developed by Biogen, VLA-1 mAb, an anti-VLA-1 integrin antibody being developed by Biogen, LTBR mAb, an anti-lymphotoxin beta receptor (LTBR) antibody being developed by Biogen, CAT-152, an anti-TGF-02 antibody being developed by Cambridge Antibody Technology, J695, an anti-IL-12 antibody being developed by Cambridge Antibody Technology and Abbott, CAT-192, an anti-TGFO1 antibody being developed by Cambridge Antibody Technology and Genzyme, CAT-213, an anti-Eotaxini antibody being developed by Cambridge Antibody Technology, LYMPHOSTAT-B™ an anti-Blys antibody being developed by Cambridge Antibody Technology and Human Genome Sciences Inc., TRAIL-R1mAb, an anti-TRAIL-RI antibody being developed by Cambridge Antibody Technology and Human Genome Sciences, Inc., AVASTIN™ (bevacizumab, rhuMAb-VEGF), an anti-VEGF antibody being developed by Genentech, an anti-HER receptor family antibody being developed by Genentech, Anti-Tissue Factor (ATF), an anti-Tissue Factor antibody being developed by Genentech, XOLAIR™ (Omalizumab), an anti-IgE antibody being developed by Genentech, RAPTIVA™ (Efalizumab), an anti-CD1a antibody being developed by Genentech and Xoma, MLN-02 Antibody (formerly LDP-02), being developed by Genentech and Millenium Pharmaceuticals, HUMAX® CD4, an anti-CD4 antibody being developed by Genmab, HUMAX®-IL15, an anti-IL15 antibody being developed by Genmab and Amgen, HUMAX®-Inflam, a anti-IL-8 antibody being developed by Genmab and Medarex, HUMAX®-Cancer, an anti-Heparanase I antibody being developed by Genmab and Medarex and Oxford GcoSciences, HUMAX®-Lymphoma, an anti-IL-15 receptor (IL-15R) antibody being developed by Genmab and Amgen, HUMAX®-TAC, an anti-IL-2 receptor (IL-2R) antibody being developed by Genmab, IDEC-131, and anti-CD40L antibody being developed by IDEC Pharmaceuticals, IDEC-151 (Cleneliximab), an anti-CD4 antibody being developed by IDEC Pharmaceuticals, IDEC-114, an anti-CD80 antibody being developed by IDEC Pharmaceuticals, IDEC-152, an anti-CD23 being developed by IDEC Pharmaceuticals, anti-macrophage migration factor (MIF) antibodies being developed by IDEC Pharmaceuticals, BEC2, an anti-idiotypic antibody being developed by Imclone, IMC-1C11, an anti-KDR antibody being developed by Imclone, DC101, an anti-fik-1 antibody being developed by Imclone, anti-VE cadherin antibodies being developed by Imclone, CEA-CIDE™ (labetuzumab), an anti-carcinoembryonic antigen (CEA) antibody being developed by Immunomedics, LYM-PHOCIDE™ (Epratuzumab), an anti-CD22 antibody being developed by Immunomedics, AFP-CIDE™, being developed by Immunomedics, MyelomaCide, being developed by Immunomedics, LkoCide, being developed by Immunomedics, PROSTACIDE™, being developed by Immunomedics, MDX-010, an anti-CTLA4 antibody being developed by Medarex, MDX-060, an anti-CD30 antibody being developed by Medarex, MDX-070 being developed by Medarex, MDX-018 being developed by Medarex, OSIDEM™ (IDM-1), and anti-Her2 antibody being developed by Medarex and Immuno-Designed Molecules, HUMAX®-CD4, an anti-CD4 antibody being developed by Medarex and Genmab, HUMAX®-IL15, an anti-IL15 antibody being developed by Medarex and Genmab, CNTO 148, an anti-TNFα antibody being developed by Medarex and Centocor/J&J, CNTO 1275, an anti-cytokine antibody being developed by Centocor/J&J, MOR101 and MOR102, anti-intercellular adhesion molecule-1 (ICAM-1) (CD54) antibodies being developed by MorphoSys, MOR201, an anti-fibroblast growth factor receptor 3 (FGFR-3) antibody being developed by MorphoSys, NUVION® (visilizumab), an anti-CD3 antibody being developed by Protein Design Labs, HUZAF™, an anti-gamma interferon antibody being developed by Protein Design Labs, Anti-u501 Integrin, being developed by Protein Design Labs, anti-IL-12, being developed by Protein Design Labs, ING-1, an anti-Ep-CAM antibody being developed by Xoma, and MLN01, an anti-Beta2 integrin antibody being developed by Xoma, an pI-ADC antibody being developed by Seattle Genetics, all of the above-cited references in this paragraph are expressly incorporated herein by reference.

IX. Antibody Compositions for In Vivo Administration

The use of the pI antibodies of the invention in therapy will depend on the antigen binding component; e.g. in the case of full length standard therapeutic antibodies, on the antigen to which the antibody's Fv binds. That is, as will be appreciated by those in the art, the treatment of specific diseases can be done with the additional benefit of mulitspecificity and/or increased half life of the molecule. This can result in a variety of benefits, including, but not limited to, novel therapeutic treatments and mechanisms, less frequent dosing (which can lead to better patient compliance), lower dosing, and lower production costs.

In another embodiment, the reduced pI variants of the invention can be utilized for intraocular/intravitreal administration of antibody against a variety of targets, including but not limited to VEGF, Ang-2, and the compliment C3 and C5 protein (or their cleavage products C3a and C5a). Due to the near-neutral pH of the eye, coupled with the high initial concentrations of injected therapeutic antibodies, there is a general risk of low solubility when the pI of the antibody approaches that of the pH in the ocular environment. In this embodiment, heterodimers may or may not be preferred; that is, homodimers of either lowered or raised pI heavy chains can be used, thus promoting high solubility upon administration.

Formulations of the antibodies used in accordance with the present invention are prepared for storage by mixing an antibody having the desired degree of purity with optional pharmaceutically acceptable carriers, excipients or stabilizers (Remington's Pharmaceutical Sciences 16th edition, Osol, A. Ed. [1980]), in the form of lyophilized formulations or aqueous solutions. Acceptable carriers, excipients, or stabilizers are nontoxic to recipients at the dosages and concentrations employed, and include buffers such as phosphate, citrate, and other organic acids; antioxidants including ascorbic acid and methionine; preservatives (such as octadecyldimethylbenzyl ammonium chloride; hexamethonium chloride; benzalkonium chloride, benzethonium chloride; phenol, butyl or benzyl alcohol; alkyl parabens such as methyl or propyl paraben; catechol; resorcinol; cyclohexanol; 3-pentanol; and m-cresol); low molecular weight (less than about 10 residues) polypeptides; proteins, such as serum albumin, gelatin, or immunoglobulins; hydrophilic polymers such as polyvinylpyrrolidone; amino acids such as glycine, glutamine, asparagine, histidine, arginine, or lysine; monosaccharides, disaccharides, and other carbohydrates including glucose, mannose, or dextrins; chelating agents such as EDTA; sugars such as sucrose, mannitol, trehalose or sorbitol; salt-forming counter-ions such as sodium; metal complexes (e.g. Zn-protein complexes); and/or non-ionic surfactants such as TWEEN™, PLURONICS™ or polyethylene glycol (PEG).

The formulation herein may also contain more than one active compound as necessary for the particular indication being treated, preferably those with complementary activities that do not adversely affect each other. For example, it may be desirable to provide antibodies with other specifcities. Alternatively, or in addition, the composition may comprise a cytotoxic agent, cytokine, growth inhibitory agent and/or small molecule antagonist. Such molecules are suitably present in combination in amounts that are effective for the purpose intended.

The active ingredients may also be entrapped in microcapsules prepared, for example, by coacervation techniques or by interfacial polymerization, for example, hydroxymethylcellulose or gelatin-microcapsules and poly-(methylmethacylate) microcapsules, respectively, in colloidal drug delivery systems (for example, liposomes, albumin microspheres, microemulsions, nano-particles and nanocapsules) or in macroemulsions. Such techniques are disclosed in Remington's Pharmaceutical Sciences 16th edition, Osol, A. Ed. (1980).

The formulations to be used for in vivo administration should be sterile, or nearly so. This is readily accomplished by filtration through sterile filtration membranes.

Sustained-release preparations may be prepared. Suitable examples of sustained-release preparations include semipermeable matrices of solid hydrophobic polymers containing the antibody, which matrices are in the form of shaped articles, e.g. films, or microcapsules. Examples of sustained-release matrices include polyesters, hydrogels (for example, poly(2-hydroxyethyl-methacrylate), or poly(vinylalcohol)), polylactides (U.S. Pat. No. 3,773,919), copolymers of L-glutamic acid and γ ethyl-L-glutamate, non-degradable ethylene-vinyl acetate, degradable lactic acid-glycolic acid copolymers such as the LUPRON DEPOT™ (injectable microspheres composed of lactic acid-glycolic acid copolymer and leuprolide acetate), and poly-D-(−)-3-hydroxybutyric acid. While polymers such as ethylene-vinyl acetate and lactic acid-glycolic acid enable release of molecules for over 100 days, certain hydrogels release proteins for shorter time periods.

When encapsulated antibodies remain in the body for a long time, they may denature or aggregate as a result of exposure to moisture at 37° C., resulting in a loss of biological activity and possible changes in immunogenicity. Rational strategies can be devised for stabilization depending on the mechanism involved. For example, if the aggregation mechanism is discovered to be intermolecular S—S bond formation through thio-disulfide interchange, stabilization may be achieved by modifying sulfhydryl residues, lyophilizing from acidic solutions, controlling moisture content, using appropriate additives, and developing specific polymer matrix compositions.

X. Administrative Modalities

The antibodies and chemotherapeutic agents of the invention are administered to a subject, in accord with known methods, such as intravenous administration as a bolus or by continuous infusion over a period of time, by intramuscular, intraperitoneal, intracerobrospinal, subcutaneous, intra-articular, intrasynovial, intrathecal, oral, topical, or inhalation routes. Intravenous or subcutaneous administration of the antibody is preferred.

XI. Treatment Modalities

In the methods of the invention, therapy is used to provide a positive therapeutic response with respect to a disease or condition. By "positive therapeutic response" is intended an improvement in the disease or condition, and/or an improvement in the symptoms associated with the disease or condition. For example, a positive therapeutic response would refer to one or more of the following improvements in the disease: (1) a reduction in the number of neoplastic cells; (2) an increase in neoplastic cell death; (3) inhibition of neoplastic cell survival; (5) inhibition (i.e., slowing to some extent, preferably halting) of tumor growth; (6) an increased patient survival rate; and (7) some relief from one or more symptoms associated with the disease or condition.

Positive therapeutic responses in any given disease or condition can be determined by standardized response criteria specific to that disease or condition. Tumor response can be assessed for changes in tumor morphology (i.e., overall tumor burden, tumor size, and the like) using screening techniques such as magnetic resonance imaging (MRI) scan, x-radiographic imaging, computed tomographic (CT) scan, bone scan imaging, endoscopy, and tumor biopsy sampling including bone marrow aspiration (BMA) and counting of tumor cells in the circulation.

In addition to these positive therapeutic responses, the subject undergoing therapy may experience the beneficial effect of an improvement in the symptoms associated with the disease.

Thus for B cell tumors, the subject may experience a decrease in the so-called B symptoms, i.e., night sweats, fever, weight loss, and/or urticaria. For pre-malignant conditions, therapy with an pI therapeutic agent may block and/or prolong the time before development of a related malignant condition, for example, development of multiple myeloma in subjects suffering from monoclonal gammopathy of undetermined significance (MGUS).

An improvement in the disease may be characterized as a complete response. By "complete response" is intended an absence of clinically detectable disease with normalization of any previously abnormal radiographic studies, bone marrow, and cerebrospinal fluid (CSF) or abnormal monoclonal protein in the case of myeloma.

Such a response may persist for at least 4 to 8 weeks, or sometimes 6 to 8 weeks, following treatment according to the methods of the invention. Alternatively, an improvement in the disease may be categorized as being a partial response. By "partial response" is intended at least about a 50% decrease in all measurable tumor burden (i.e., the number of malignant cells present in the subject, or the measured bulk of tumor masses or the quantity of abnormal monoclonal protein) in the absence of new lesions, which may persist for 4 to 8 weeks, or 6 to 8 weeks.

Treatment according to the present invention includes a "therapeutically effective amount" of the medicaments used. A "therapeutically effective amount" refers to an amount effective, at dosages and for periods of time necessary, to achieve a desired therapeutic result.

A therapeutically effective amount may vary according to factors such as the disease state, age, sex, and weight of the individual, and the ability of the medicaments to elicit a desired response in the individual. A therapeutically effective amount is also one in which any toxic or detrimental effects of the antibody or antibody portion are outweighed by the therapeutically beneficial effects.

A "therapeutically effective amount" for tumor therapy may also be measured by its ability to stabilize the progression of disease. The ability of a compound to inhibit cancer may be evaluated in an animal model system predictive of efficacy in human tumors.

Alternatively, this property of a composition may be evaluated by examining the ability of the compound to inhibit cell growth or to induce apoptosis by in vitro assays known to the skilled practitioner. A therapeutically effective amount of a therapeutic compound may decrease tumor size, or otherwise ameliorate symptoms in a subject. One of ordinary skill in the art would be able to determine such amounts based on such factors as the subject's size, the severity of the subject's symptoms, and the particular composition or route of administration selected.

Dosage regimens are adjusted to provide the optimum desired response (e.g., a therapeutic response). For example, a single bolus may be administered, several divided doses may be administered over time or the dose may be proportionally reduced or increased as indicated by the exigencies of the therapeutic situation. Parenteral compositions may be formulated in dosage unit form for ease of administration and uniformity of dosage. Dosage unit form as used herein refers to physically discrete units suited as unitary dosages for the subjects to be treated; each unit contains a predetermined quantity of active compound calculated to produce the desired therapeutic effect in association with the required pharmaceutical carrier.

The specification for the dosage unit forms of the present invention are dictated by and directly dependent on (a) the unique characteristics of the active compound and the particular therapeutic effect to be achieved, and (b) the limitations inherent in the art of compounding such an active compound for the treatment of sensitivity in individuals.

The efficient dosages and the dosage regimens for the pI antibodies used in the present invention depend on the disease or condition to be treated and may be determined by the persons skilled in the art.

An exemplary, non-limiting range for a therapeutically effective amount of an pI antibody used in the present invention is about 0.1-100 mg/kg, such as about 0.1-50 mg/kg, for example about 0.1-20 mg/kg, such as about 0.1-10 mg/kg, for instance about 0.5, about such as 0.3, about 1, or about 3 mg/kg. In another embodiment, he antibody is administered in a dose of 1 mg/kg or more, such as a dose of from 1 to 20 mg/kg, e.g. a dose of from 5 to 20 mg/kg, e.g. a dose of 8 mg/kg.

A medical professional having ordinary skill in the art may readily determine and prescribe the effective amount of the pharmaceutical composition required. For example, a physician or a veterinarian could start doses of the medicament employed in the pharmaceutical composition at levels lower than that required in order to achieve the desired therapeutic effect and gradually increase the dosage until the desired effect is achieved.

In one embodiment, the pI antibody is administered by infusion in a weekly dosage of from 10 to 500 mg/kg such as of from 200 to 400 mg/kg Such administration may be repeated, e.g., 1 to 8 times, such as 3 to 5 times. The administration may be performed by continuous infusion over a period of from 2 to 24 hours, such as of from 2 to 12 hours.

In one embodiment, the pI antibody is administered by slow continuous infusion over a long period, such as more than 24 hours, if required to reduce side effects including toxicity.

In one embodiment the pI antibody is administered in a weekly dosage of from 250 mg to 2000 mg, such as for example 300 mg, 500 mg, 700 mg, 1000 mg, 1500 mg or 2000 mg, for up to 8 times, such as from 4 to 6 times. The administration may be performed by continuous infusion over a period of from 2 to 24 hours, such as of from 2 to 12 hours. Such regimen may be repeated one or more times as necessary, for example, after 6 months or 12 months. The dosage may be determined or adjusted by measuring the amount of compound of the present invention in the blood upon administration by for instance taking out a biological sample and using anti-idiotypic antibodies which target the antigen binding region of the pI antibody.

In a further embodiment, the pI antibody is administered once weekly for 2 to 12 weeks, such as for 3 to 10 weeks, such as for 4 to 8 weeks.

In one embodiment, the pI antibody is administered by maintenance therapy, such as, e.g., once a week for a period of 6 months or more.

In one embodiment, the pI antibody is administered by a regimen including one infusion of an pI antibody followed by an infusion of an pI antibody conjugated to a radioisotope. The regimen may be repeated, e.g., 7 to 9 days later.

As non-limiting examples, treatment according to the present invention may be provided as a daily dosage of an antibody in an amount of about 0.1-100 mg/kg, such as 0.5, 0.9, 1.0, 1.1, 1.5, 2, 3, 4, 5, 6, 7, 8, 9, 10, 11, 12, 13, 14, 15, 16, 17, 18, 19, 20, 21, 22, 23, 24, 25, 26, 27, 28, 29, 30, 40, 45, 50, 60, 70, 80, 90 or 100 mg/kg, per day, on at least one of day 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, or 40, or alternatively, at least one of week 1, 2, 3, 4, 5, 6, 7, 8, 9, 10, 11, 12, 13, 14, 15, 16, 17, 18, 19 or 20 after initiation of treatment, or any combination thereof, using single or divided doses of every 24, 12, 8, 6, 4, or 2 hours, or any combination thereof.

In some embodiments the pI antibody molecule thereof is used in combination with one or more additional therapeutic agents, e.g. a chemotherapeutic agent. Non-limiting examples of DNA damaging chemotherapeutic agents include topoisomerase I inhibitors (e.g., irinotecan, topotecan, camptothecin and analogs or metabolites thereof, and doxorubicin); topoisomerase II inhibitors (e.g., etoposide, teniposide, and daunorubicin); alkylating agents (e.g., melphalan, chlorambucil, busulfan, thiotepa, ifosfamide, carmustine, lomustine, semustine, streptozocin, decarbazine, methotrexate, mitomycin C, and cyclophosphamide); DNA intercalators (e.g., cisplatin, oxaliplatin, and carboplatin); DNA intercalators and free radical generators such as bleomycin; and nucleoside mimetics (e.g., 5-fluorouracil, capecitibine, gemcitabine, fludarabine, cytarabine, mercaptopurine, thioguanine, pentostatin, and hydroxyurea).

Chemotherapeutic agents that disrupt cell replication include: paclitaxel, docetaxel, and related analogs; vincristine, vinblastin, and related analogs; thalidomide, lenalidomide, and related analogs (e.g., CC-5013 and CC-4047); protein tyrosine kinase inhibitors (e.g., imatinib mesylate and gefitinib); proteasome inhibitors (e.g., bortezomib); NF-κB inhibitors, including inhibitors of IκB kinase; antibodies which bind to proteins overexpressed in cancers and thereby downregulate cell replication (e.g., trastuzumab, rituximab, cetuximab, and bevacizumab); and other inhibitors of proteins or enzymes known to be upregulated, over-expressed or activated in cancers, the inhibition of which downregulates cell replication.

In some embodiments, the antibodies of the invention can be used prior to, concurrent with, or after treatment with VELCADE® (bortezomib).

Examples

Examples are provided below to illustrate the present invention. These examples are not meant to constrain the present invention to any particular application or theory of operation. For all constant region positions discussed in the present invention, numbering is according to the EU index as in Kabat (Kabat et al., 1991, *Sequences of Proteins of Immunological Interest*, 5th Ed., United States Public Health Service, National Institutes of Health, Bethesda, entirely incorporated by reference). Those skilled in the art of antibodies will appreciate that this convention consists of nonsequential numbering in specific regions of an immunoglobulin sequence, enabling a normalized reference to conserved positions in immunoglobulin families. Accordingly, the positions of any given immunoglobulin as defined by the EU index will not necessarily correspond to its sequential sequence.

Example 1. Design of Non-Native Charge Substitutions to Reduce pI

Antibody constant chains were modified with lower pI by engineering substitutions in the constant domains. Reduced pI can be engineered by making substitutions of basic amino acids (K or R) to acidic amino acids (D or E), which result in the largest decrease in pI. Mutations of basic amino acids to neutral amino acids and neutral amino acids to acidic amino acids will also result in a decrease in pI. A list of amino acid pK values can be found in Table 1 of Bjellqvist et al., 1994, Electrophoresis 15:529-539.

We chose to explore substitutions in the antibody CH1 (Cγ1) and CL (Ckappa or CK) regions (sequences are shown in FIG. 1) because, unlike the Fc region, they do not interact with native ligands that impact the antibody's pharmacological properties. In deciding which positions to mutate, the surrounding environment and number of contacts the WT amino acid makes with its neighbors was taken into account such as to minimize the impact of a substitution or set of substitutions on structure and/or function. The solvent accessibility or fraction exposed of each CH1 and CK position was calculated using relevant crystal structures of antibody Fab domains. The results are shown in FIGS. 2 and 3 for the Cγ1 and CK respectively. Design was guided further by examining the CH1 and CL domains for positions that are isotypic between the immunoglobulin isotypes (IgG1, IgG2, IgG3, and IgG4). Because such variations occur naturally, such position are expected to be amenable to substitution. Based on this analysis, a number of substitutions were identified that reduce pI but are predicted to have minimal impact on the biophysical properties of the domains.

Example 2. Anti-VEGF Antibodies with Engineered CH1 and CK Regions Having Lower pI Amino acid modifications were engineered in the CH1 and CK domains of an IgG1 antibody to lower the pI of the antibody. Based on the above analysis, chosen substitutions for the heavy chain CH1 were 119E, 133E, 164E, 205E, 208D, and 210E, and substitutions for the light chain Cκ substitutions were 126E, 145E, 152D, 156E, 169E, and 202E. These variant constant chains are referred to as IgG-CH1-pI(6) and CK-pI(6) respectively, and their amino acid sequences are provided in FIG. 4.

CH1 and CK variants were engineered in the context of an antibody targeting vascular endothelial factor (VEGF). The heavy and light chain variable regions (VH and VL) are those of a humanized version of the antibody A4.6.1, also referred to as bevacizumab (AVASTIN®), which is approved for the treatment of a variety of cancers. These variable region sequences are provided in FIG. 5. The anti-VEGF antibody variant containing the low pI substitutions is referred to as XENP9493 Bevacizumab-IgG1-CH-pI(6)-CK-pI(6), and the amino acid sequences of the heavy and light chains of this antibody are provided in FIG. 6. A structural model of the Fab domain showing the 6 substitutions of CH1-pI(6) and the 6 substitutions of CK-pI(6) is shown in FIG. 7. The calculated pI of WT anti-VEGF (bevacizumab) is 8.14. The calculated pI of the engineered anti-VEGF CH1 variant is 6.33 and that of the anti-VEGF CK variant is 6.22. When the heavy chain and light chain pI engineered anti-VEGF variants are co-transfected, the full-length anti-VEGF mAb has a calculated pI of 5.51.

Genes encoding the heavy and light chains of the anti-VEGF antibodies were constructed in the mammalian expression vector pTT5. The human IgG1 constant chain gene was obtained from IMAGE clones and subcloned into the pTT5 vector. VH and VL genes encoding the anti-VEGF antibodies were synthesized commercially (Blue Heron Biotechnologies, Bothell Wash.), and subcloned into the vectors encoding the appropriate CL and IgG1 constant chains. Amino acid modifications were constructed using site-directed mutagenesis using the QUIKCHANGE® site-directed mutagenesis methods (Stratagene, La Jolla Calif.). All DNA was sequenced to confirm the fidelity of the sequences.

Plasmids containing heavy chain gene (VH-Cγ1-Cγ2-Cγ3) were co-transfected with plasmid containing light chain gene (VL-Cκ) into 293E cells using LIPOFECTAMINE® transfection reagent (Invitrogen, Carlsbad Calif.) and grown in FREESTYLE™ 293 media (Invitrogen, Carlsbad Calif.). After 5 days of growth, the antibodies were purified from the culture supernatant by protein A affinity using the MABSELECT® resin (GE Healthcare). Antibody concentrations were determined by bicinchoninic acid (BCA) assay (Pierce).

Figure 8:
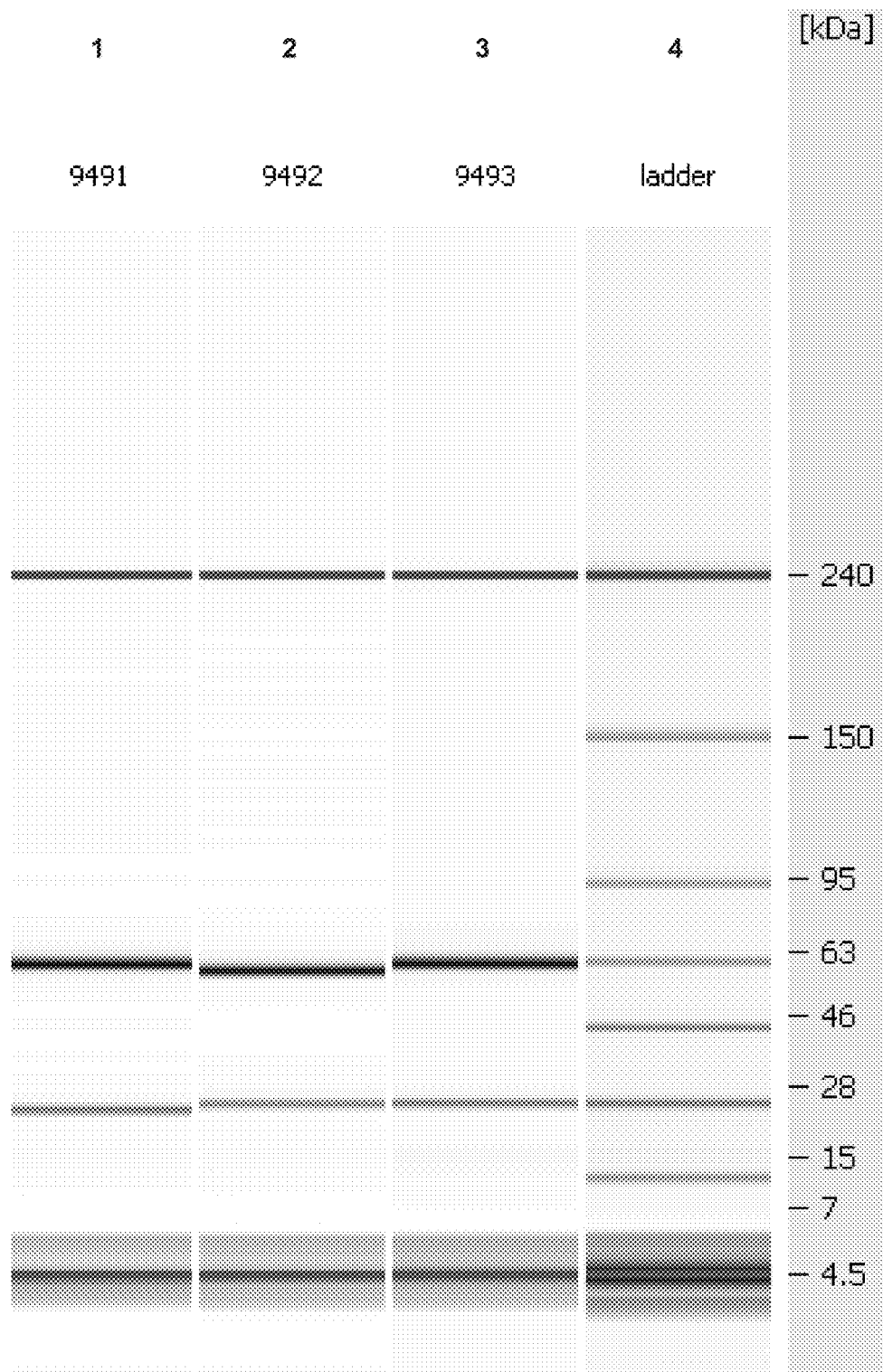
FIG. 8. Analysis of pI engineered anti-VEGF variants on an Agilent Bioanalyzer showing high purity.
Figure 9:
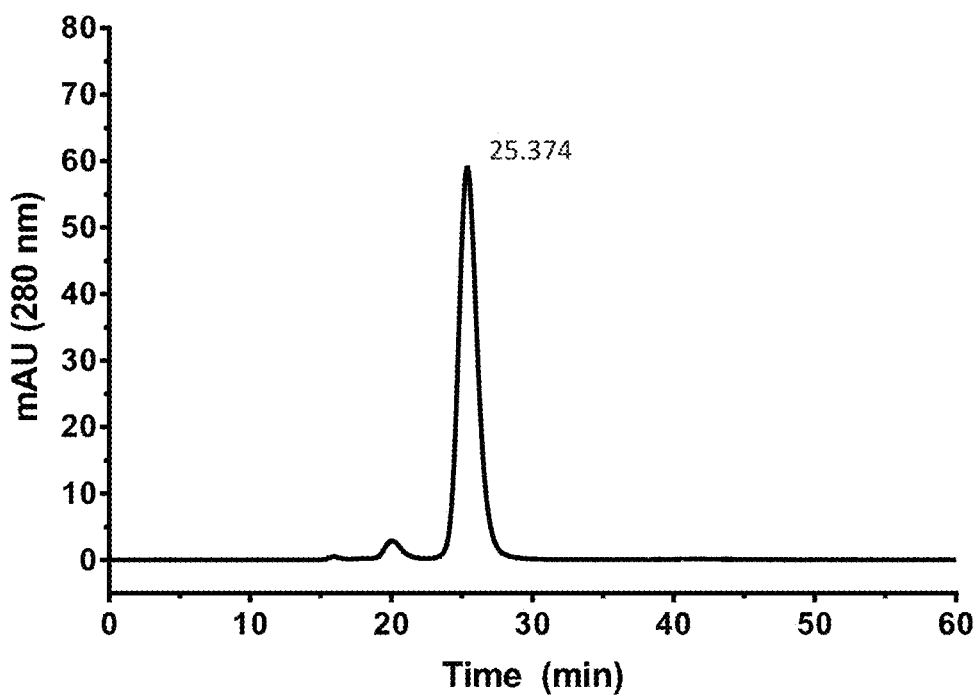
FIG. 9. Analysis of pI engineered anti-VEGF variants on SEC showing high purity.
Figure 12:
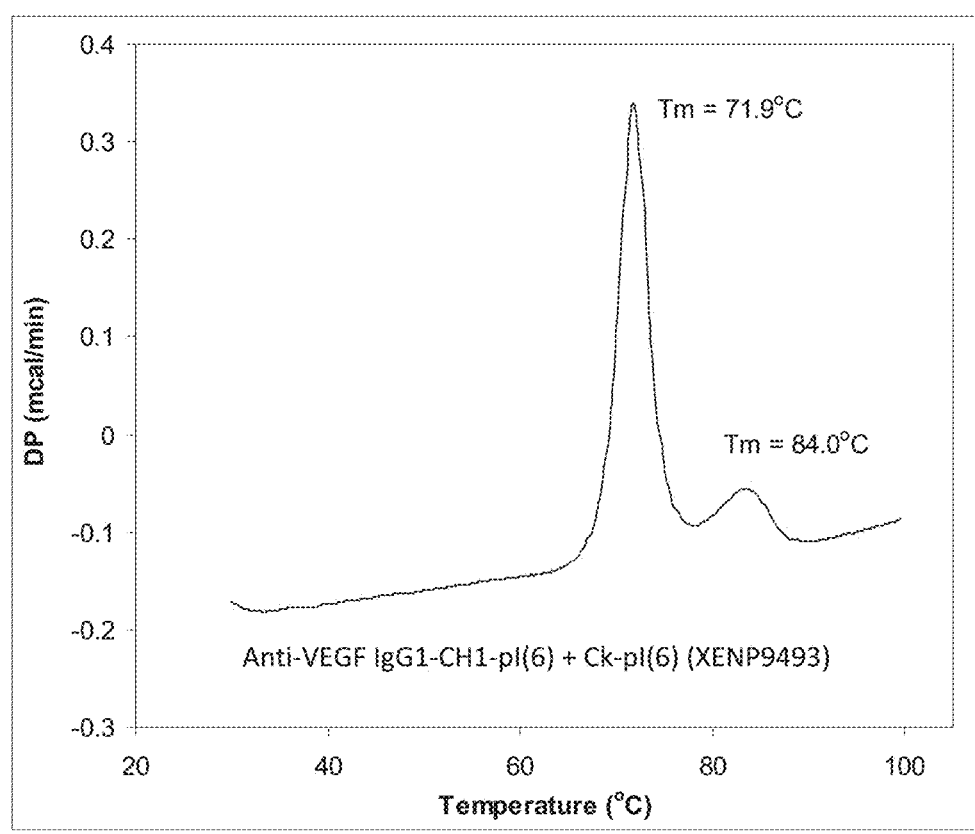
FIG. 12. DSC analysis of CH1 and CK pI engineered anti-VEGF showing high thermostability.

The pI engineered anti-VEGF mAbs were characterized by SDS PAGE on an Agilent Bioanalyzer (FIG. 8), by size exclusion chromatography (SEC) (FIG. 9), isoelectric focusing (IEF) gel electrophoresis (FIG. 10), binding to antigen VEGF by BIACORE® (FIG. 11), and differential scanning calorimetry (DSC) (FIG. 12). All mAbs showed high purity on SDS-PAGE and SEC. IEF gels indicated that each variant had the designed isoelectric point. VEGF binding analysis on BIACORE® showed that pI engineered anti-VEGF bound to VEGF with similar affinity as bevacizumab, indicating that the designed substitutions did not perturb the function of the mAb. DSC showed that the anti-VEGF variant with both CH1 and CL engineered substitutions had high thermostability with a Tm of 71.9° C.

Pharmacokinetic experiments were performed in B6 mice that are homozygous knock-outs for murine FcRn and heterozygous knock-ins of human FcRn (mFcRn$^{-/-}$, hFcRn$^+$) (Petkova et al., 2006, Int Immunol 18(12):1759-69, entirely incorporated by reference), herein referred to as hFcRn or hFcRn$^+$ mice. Samples tested included the parent IgG1/2 constant region, the pI-engineered variant with a pI of 5.51, referred to as IgG1_CH-CL_pI_eng, and an Fc variant version of IgG/2 containing the substitution N434S, which improves affinity to human FcRn.

A single, intravenous tail vein injection of anti-VEGF antibody (2 mg/kg) was given to groups of 4-7 female mice randomized by body weight (20-30 g range). Blood (~50 ul) was drawn from the orbital plexus at each time point, processed to serum, and stored at −80° C. until analysis. Antibody concentrations were determined using an ELISA assay. Serum concentration of antibody was measured using a recombinant VEGF (VEGF-165, PeproTech, Rocky Hill, N.J.) as capture reagent, and detection was carried out with biotinylated anti-human kappa antibody and europium-labeled streptavidin. The time resolved fluorescence signal was collected. PK parameters were determined for individual mice with a non-compartmental model using WIN-NONLIN® software (Pharsight Inc, Mountain View Calif.). Nominal times and dose were used with uniform weighing of points.

Figure 13:
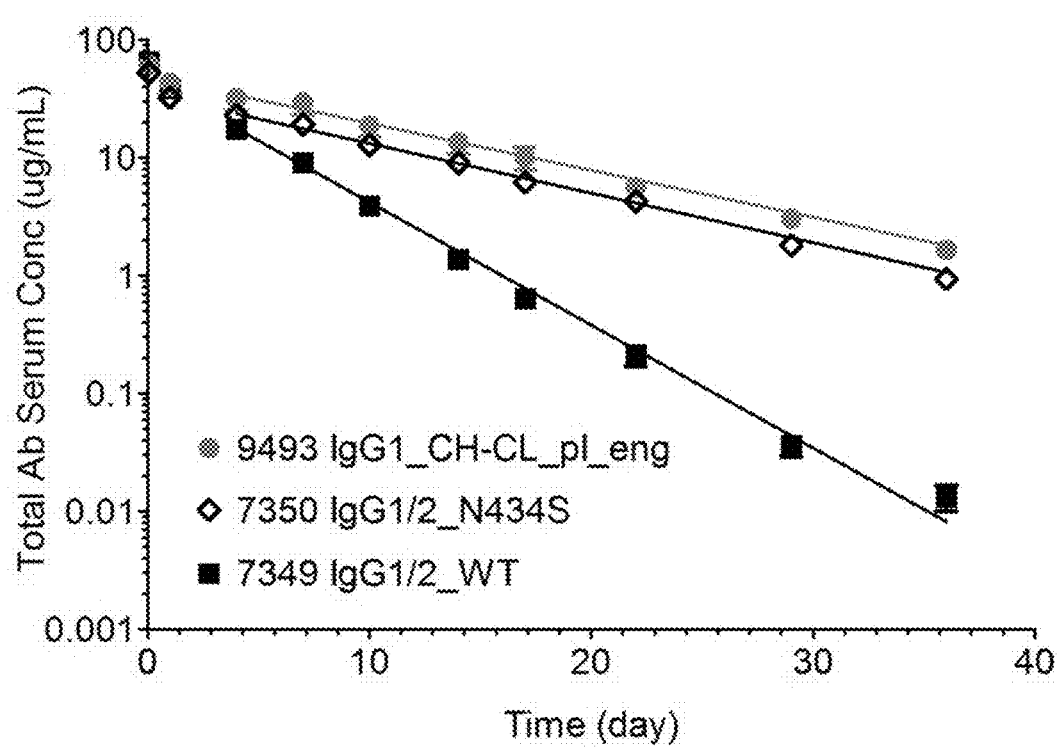
FIG. 13. PK of bevacizumab variants in huFcRn mice. The 9493 variant with pI-engineered CH1 and CK domains extends half-life in vivo.

Results are shown in FIG. 13. Fitted half-life (t1/2) values, which represents the beta phase that characterizes elimination of antibody from serum, are shown in Table 1. The pI-engineered variant, containing substitutions in CH1 and CL that reduce the pI, extended half-life to 7.4 days, an improvement of approximately 2.6-fold relative to IgG1/2. The pI-engineered variant had a comparable half-life to the Fc variant version N434S. Combinations of antibody variants are contemplated that reduce pI and improve affinity for FcRn for extending the half-lives of antibodies and Fc fusions.

TABLE 1

PK results of pI-engineered variant

| Group | Variant | n | Individual mice t½ (days) | | | | Average t½ (days) | St. Dev. (days) |
|---|---|---|---|---|---|---|---|---|
| | | | n1 | n2 | n3 | n4 | | |
| 7349 | IgG1/2_WT | 4 | 2.9 | 2.5 | 3.2 | 2.8 | 2.9 | 0.3 |
| 7350 | IgG1/2_N434S | 4 | 6.3 | 7.7 | 7.3 | 6.5 | 7.0 | 0.7 |
| 9493 | IgG1_CH-CL_pI_eng | 3 | 7.4 | 8.4 | 6.4 | | 7.4 | 1.0 |

Example 3. PK Analysis of IgG Constant Regions

Figure 14:
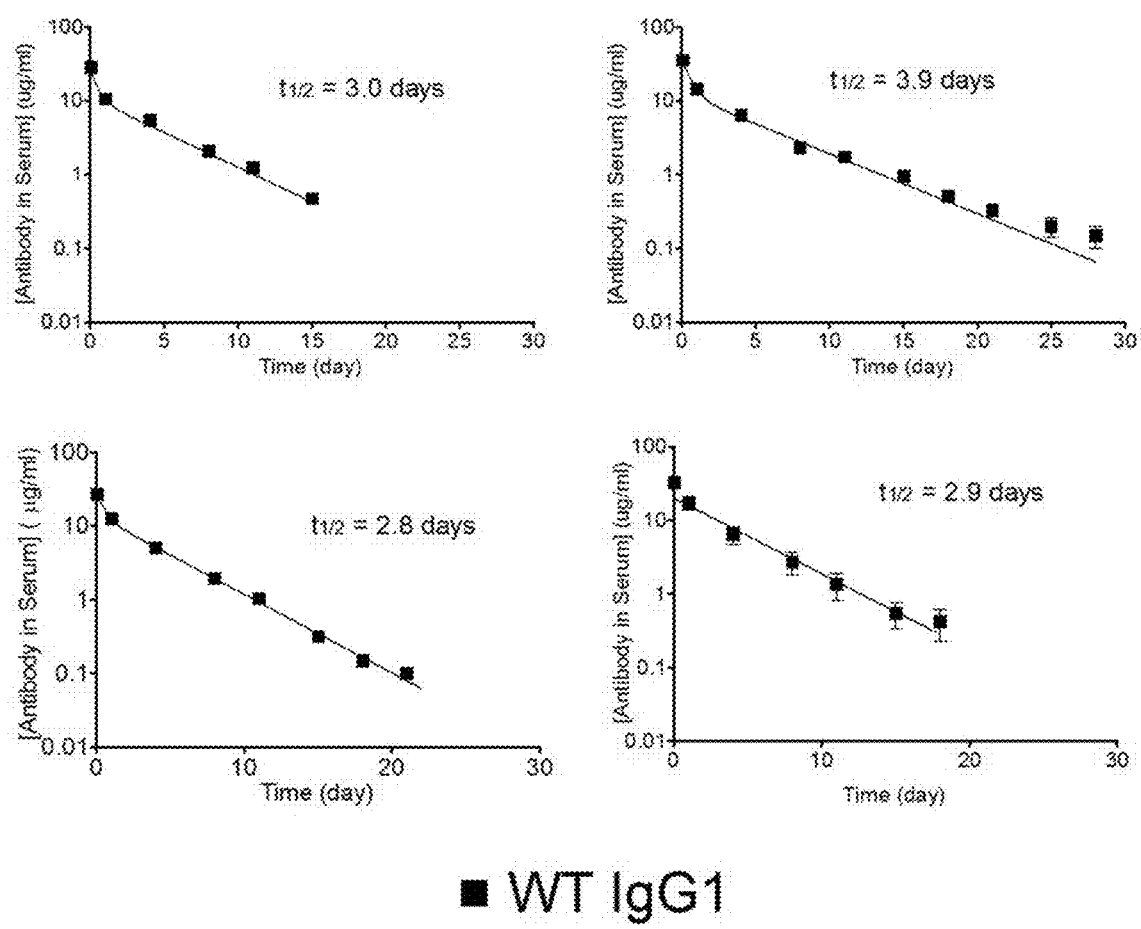
FIG. 14. PK of a native IgG1 version of bevacizumab in four separate in vivo studies in huFcRn mice. The average IgG1 half-life was 3.2 days.
Figure 15:
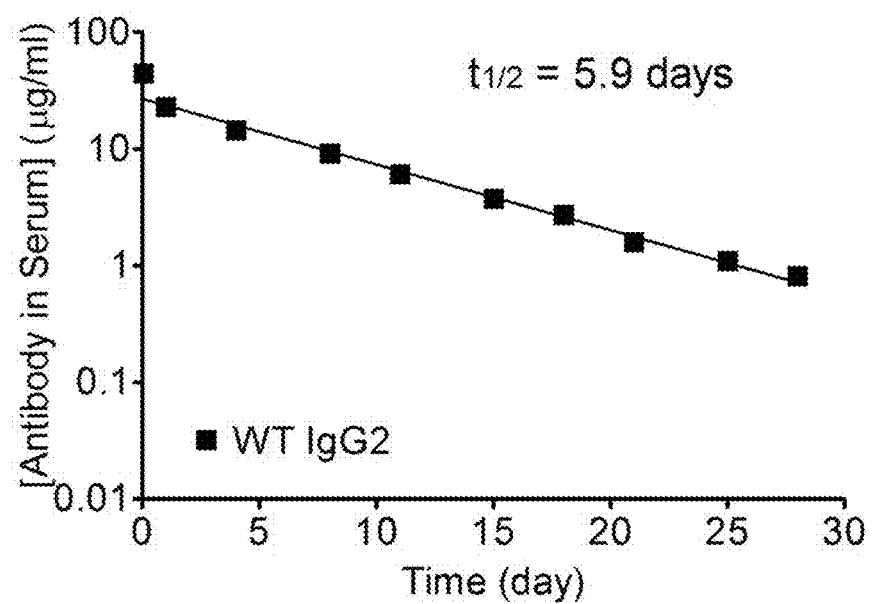
FIG. 15. PK of a native IgG2 version of bevacizumab in huFcRn mice.

PK studies of IgG1 and IgG2 isotype versions of bevacizumab were carried out in the huFcRn mice as described above. The IgG1 results from four separate PK studies are shown in FIG. 14. The half-lives from the four studies were 3.0, 3.9, 2.8, and 2.9 days, resulting in an average half-life of 3.2 days. The PK results from the IgG2 study are shown in FIG. 15. The half-life of IgG2 was 5.9 days.

Figure 16:
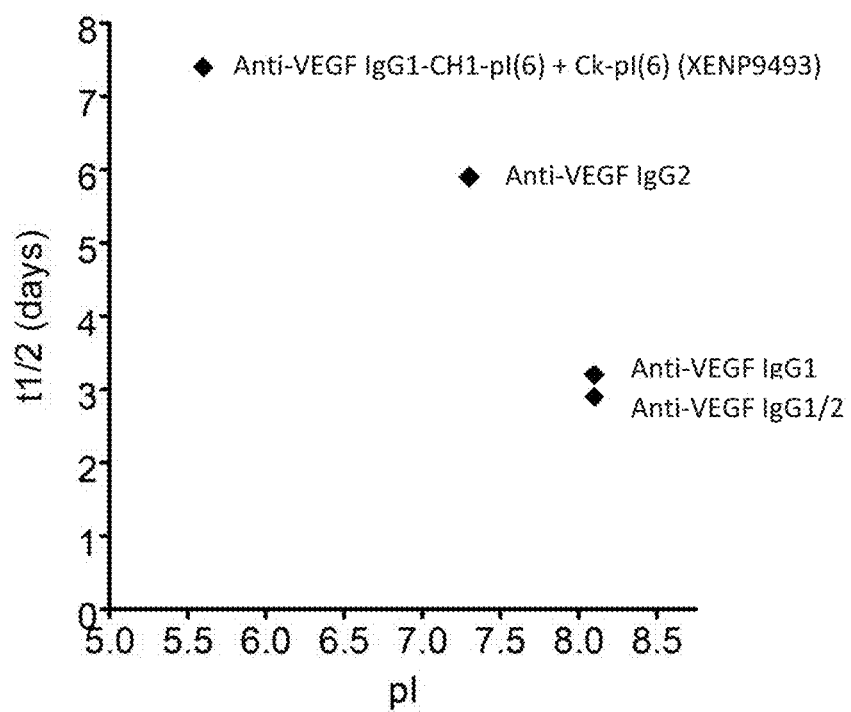
FIG. 16. Correlation between half-life and isoelectric point (pI) of antibody variants with different constant chains.

The PK results from the the IgG1 and IgG2 were analyzed with the results from the IgG1/2 and pI-engineered versions of bevacizumab. Table 2 shows the half-lives of the antibodies along with their calculated pI. These data are plotted in FIG. 16.

TABLE 2

PK results of antibodies with identical Fv (bevacizumab) but constant regions with different pI's

| XENP | IgG | pI | Average t½ (days) |
|---|---|---|---|
| 4547 | IgG1 | 8.1 | 3.2 |
| 7349 | IgG1/2 | 8.1 | 2.9 |
| 6384 | IgG2 | 7.3 | 5.9 |
| 9493 | IgG1_CH-CL_pI_eng [aka IgG1-pI(12)] | 5.6 | 7.4 |

A correlation was observed between half-life and the pI of the antibodies. These data further suggest that engineering of antibody constant chains, including heavy and light chain constant regions, for reduced isoelectric point is potentially a novel generalizable approach to extending the serum half-lives of antibodies and Fc fusions.

Example 4. Engineering Approaches to Constant Region pI Engineering

Reduction in the pI of a protein or antibody can be carried out using a variety of approaches. At the most basic level, residues with high pKa's (lysine, arginine, and to some extent histidine) are replaced with neutral or negative residues, and/or neutral residues are replaced with low pKa residues (aspartic acid and glutamic acid). The particular replacements may depend on a variety of factors, including location in the structure, role in function, and immunogenicity.

Because immunogenicity is a concern, efforts can be made to minimize the risk that a substitution that lowers the pI will elicit immunogenicity. One way to minimize risk is to minimize the mutational load of the variants, i.e. to reduce the pI with the fewest number of mutations. Charge swapping mutations, where a K, R, or H is replaced with a D or E, have the greatest impact on reducing pI, and so these substitutions are preferred. Another approach to minimizing the risk of immunogenicity while reducing pI is to utilize substitutions from homologous human proteins. Thus for antibody constant chains, the isotypic differences between the IgG subclasses (IgG1, IgG2, IgG3, and IgG4) provide low-risk substitutions. Because immune recognition occurs at a local sequence level, i.e. MHC II and T-cell receptors recognize epitopes typically 9 residues in length, pI-altering substitutions may be accompanied by isotypic substitutions proximal in sequence. In this way, epitopes can be extended to match a natural isotype. Such substitutions would thus make up epitopes that are present in other human IgG isotypes, and thus would be expected to be tolerized.

FIG. 17 shows an amino acid sequence alignment of the IgG subclasses. Residues with a bounded box illustrate isotypic differences between the IgG's. Residues which contribute to a higher pI (K, R, and H) or lower pI (D and E) are highlighted in bold. Designed substitutions that either lower the pI, or extend an epitope to match a natural isotype are shown in gray.

FIG. 18 shows the amino acid sequence of the Cκ and Cλ light constant chains. Homology between Cκ and Cλ is not as high as between the IgG subclasses. Nonetheless the alignment may be used to guide substitutions. Residues which contribute to a higher pI (K, R, and H) or lower pI (D and E) are highlighted in bold. Gray indicates lysine, arginines, and histidines that may be substituted, preferably with aspartic or glutatmic acids, to lower the isoelectric point.

Another approach to engineering lower pI into proteins and antibodies is to fuse negatively charged residues to the N- or C-termini. Thus for example, peptides consisting principally of aspartic acids and glutamic acid may be fused to the N-terminus or C-terminus to the antibody heavy chain, light chain or both. Because the N-termini are structurally close to the antigen binding site, the C-termini are preferred.

Based on the described engineering approaches, a number of variants were designed to reduce the isoelectric point of both the antibody heavy chain and light chain. The heavy chain variants comprise various combinations of isotypic substitutions, as well as C-terminal negatively charged peptides. Relative to a native IgG1, the variants comprise one or more isotypic substitutions from the group consisting of G137E, G138S, S192N, L193F, I199T, N203D, K214T, K222T, substitution of 221-225 DKTHT to VE, H268Q, K274Q, R355Q, N384S, K392N, V397M, Q419E, and a deletion of K447 (referred to as K447#), wherein numbering is according to the EU index. The light chain variants comprise various combinations of non-isotypic substitutions and C-terminal negatively charged peptides. CK variants comprise one or more substitutions from the group consisting of K126E, K145E, N152D, S156E, K169E, and S202E, wherein numbering is according to the EU index.

Sequences of the variant heavy chains are provided in FIG. 19, and sequences of the variant light chains are provided in FIG. 20. Table 3 lists the variants constructed, along with the calculated pI's of the heavy constant chain, light constant chain, as well as the pI of the full length monoclonal antibody (mAb) containing the variable region (Fv) of the anti-VEGF antibody Bevacizumab.

TABLE 3 pI-engineered antibody constant chain variants

| Heavy Chain | | Light Chain | | Fv | | | mAb[b] |
|---|---|---|---|---|---|---|---|
| Identity | pI | Identity | pI | Identity[a] | VH pI | VL pI | pI |
| IgG1-WT | 8.46 | Ck-WT | 6.1 | Bev | 6.99 | 6.75 | 8.10 |
| IgG1-WT | 8.46 | Ck-pI(3) | 4.6 | Bev | 6.99 | 6.75 | 6.58 |
| IgG1-WT | 8.46 | Ck-pI(6) | 4.4 | Bev | 6.99 | 6.75 | 6.21 |
| IgG1-WT | 8.46 | Ck-pI(6-DEDE) | 4.3 | Bev | 6.99 | 6.75 | 5.85 |
| IgG2-WT | 7.66 | Ck-WT | 6.1 | Bev | 6.99 | 6.75 | 7.31 |
| IgG2-WT | 7.66 | Ck-pI(3) | 4.6 | Bev | 6.99 | 6.75 | 6.16 |
| IgG2-WT | 7.66 | Ck-pI(6) | 4.4 | Bev | 6.99 | 6.75 | 5.88 |
| IgG2-WT | 7.66 | Ck-pI(6-DEDE) | 4.3 | Bev | 6.99 | 6.75 | 5.58 |
| pI-iso1 | 5.93 | Ck-WT | 6.1 | Bev | 6.99 | 6.75 | 6.16 |
| pI-iso1(NF) | 5.93 | Ck-WT | 6.1 | Bev | 6.99 | 6.75 | 6.16 |
| pI-iso1(NF-VE) | 5.85 | Ck-WT | 6.1 | Bev | 6.99 | 6.75 | 6.11 |
| pI-iso1(NF-VE) | 5.85 | Ck-pI(3) | 4.6 | Bev | 6.99 | 6.75 | 5.58 |
| pI-iso1(NF-VE) | 5.85 | Ck-pI(6) | 4.4 | Bev | 6.99 | 6.75 | 5.38 |
| pI-iso1(NF-VE) | 5.85 | Ck-pI(6-DEDE) | 4.3 | Bev | 6.99 | 6.75 | 5.18 |
| pI-iso1(NF-VE-DEDE) | 5.36 | Ck-WT | 6.1 | Bev | 6.99 | 6.75 | 5.74 |
| pI-iso1(NF-VE-DEDE) | 5.36 | Ck-pI(3) | 4.6 | Bev | 6.99 | 6.75 | 5.32 |
| pI-iso1(NF-VE-DEDE) | 5.36 | Ck-pI(6) | 4.4 | Bev | 6.99 | 6.75 | 5.18 |
| pI-iso1(NF-VE-DEDE) | 5.36 | Ck-pI(6-DEDE) | 4.3 | Bev | 6.99 | 6.75 | 5.03 |

[a]Bev = the variable region of the anti-VEGF antibody Bevacizumab
[b]mAb pI = the pI of the full length monoclonal antibody containing the Fv of Bevacizumab Example 5. Determination of Charge-Dependency of pI Engineering and Potential Combination with Fc Variants that Enhance Binding to FcRn A series of new pI-engineered variants were generated to test two aspects of the relationship between low pI and extended half-life. First, the parameter of charge was investigated by making a controlled set of variants based on the 9493 IgG-pI(12) variant. These variants, 10017, 10018, and 10019, are described in Table 4, along with their pI and the differences in positively and negatively charged residues relative to bevacizumab IgG1 WT.

TABLE 4

Engineered constructs exploring charge and Fc variants

| XENP | HC Identity | HC Substitutions | LC Substitutions | pI | Charge State | # KR | # DE |
|---|---|---|---|---|---|---|---|
| 4547 | IgG1-WT | | | 8.1 | (+6) | 0 | 0 |
| 9493 | IgG1-pI(12) | CH1-pI(6) | Ck-pI(6) | 5.6 | (−30) | (−12) | (+24) |
| 9992 | IgG1-pI(12) | CH1-pI(6) + N434S | Ck-pI(6) | 5.6 | (−30) | (−12) | (+24) |
| 9993 | IgG1-pI(12) | CH1-pI(6) + M428L/N434S | Ck-pI(6) | 5.6 | (−30) | (−12) | (+24) |
| 10017 | IgG1-pI(6)-Neutral-to-DE | S119E T164E N208D | N152D S156E S202E | 6.6 | (−6) | 0 | (+12) |
| 10018 | IgG1-pI(6)-KR-to-Neutral | K133Q K205Q K210Q | K126Q K145Q K169Q | 6.6 | (−6) | (−12) | 0 |
| 10019 | IgG1-pI(6)-KR-to-DE | K133E K205E K210E | K126E K145E K169E | 5.9 | (−18) | (−12) | (+12) |

CH1-pI(6) = S119E K133E T164E K205E N208D K210E
Ck-pI(6) = K126E K145E N152D S156E K169E S202E
pI calculated with Fv = Bevacizumab The experimental rationale here is as follows. If all the mechanism for improved half-life is based on removal of positive charge, 10018 and 10019 should be as good as 9493 while 10017 would not be extended. If the mechanism is based on an increase in negative charge, 10018 will not be extended, while 10017 and 10019 will have equivalent half-life that is extended relative to IgG1 but shorter than 9493. If overall pI (or charge state) is the basis, the result will be 9493>10019>10017=10018.

In addition to the charge-controlled variant set, the 9493 IgG-pI(12) variant was combined with substitutions that improve binding to FcRn at pH 6.0 in order to test whether the two mechanisms of half-life improvement, charge state and FcRn, are compatible. These variants, 9992 IgG-pI(12)-N434S and 9993 IgG1-pI(12)-M428L/N434S, are listed in Table 4.

Figure 21:
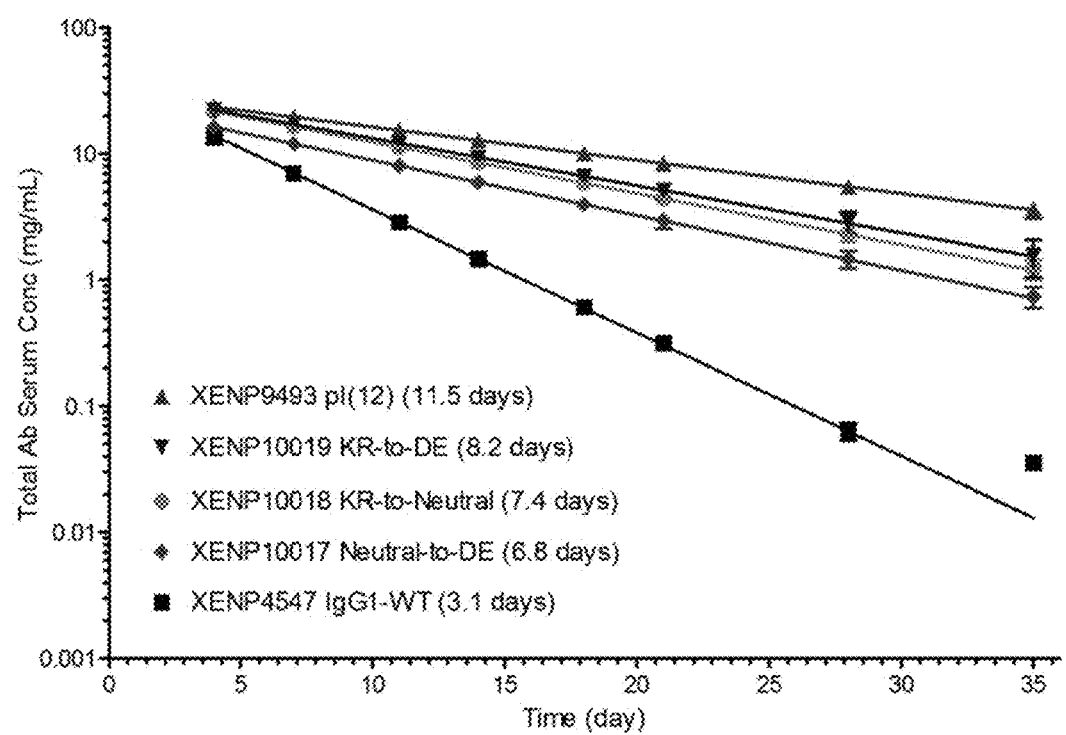
FIG. 21. PK results of pI-engineered variant bevacizumab antibodies in huFcRn mice.
Figure 22:
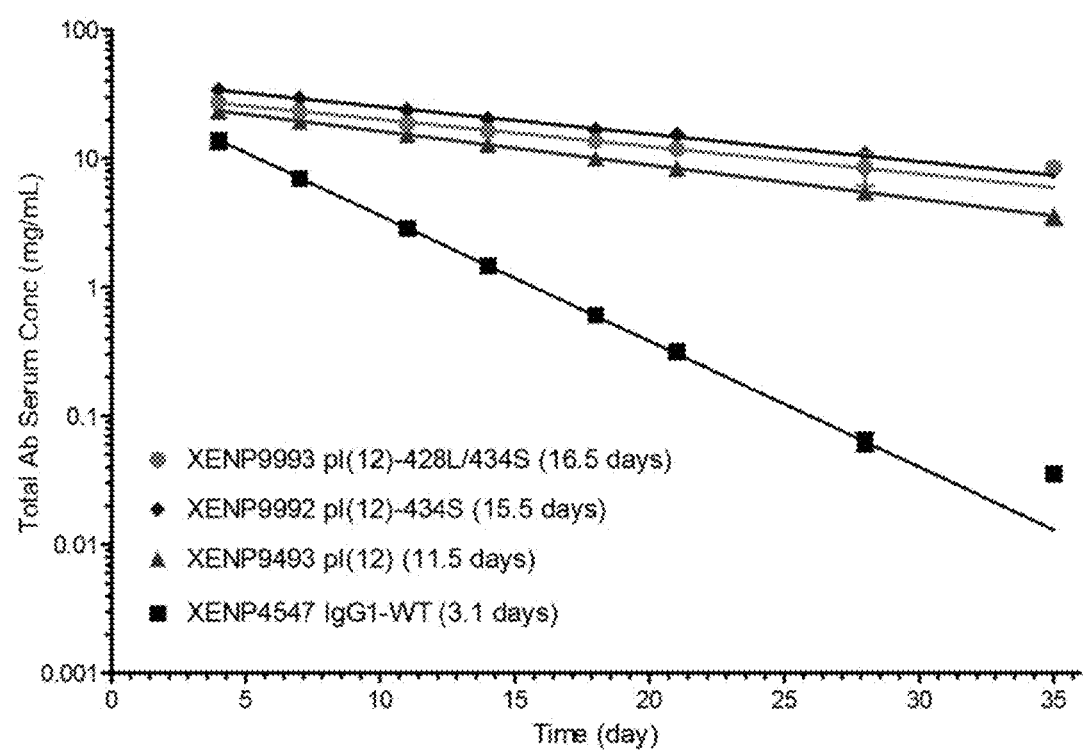
FIG. 22. PK results of variants that combine pI-engineered modifications with Fc modifications that enhance binding to FcRn.

Antibody variants were constructed with the variable region of bevacizumab using molecular biology techniques as described above. Antibodies were expressed, purified, and characterized as described above. PK studies of the variant and control antibodies were carried out in the huFcRn mice as described above. The group mean averages of the serum concentrations are plotted in FIGS. 21 and 22, along with the half-lives obtained from the fits of the data.

Figure 23:
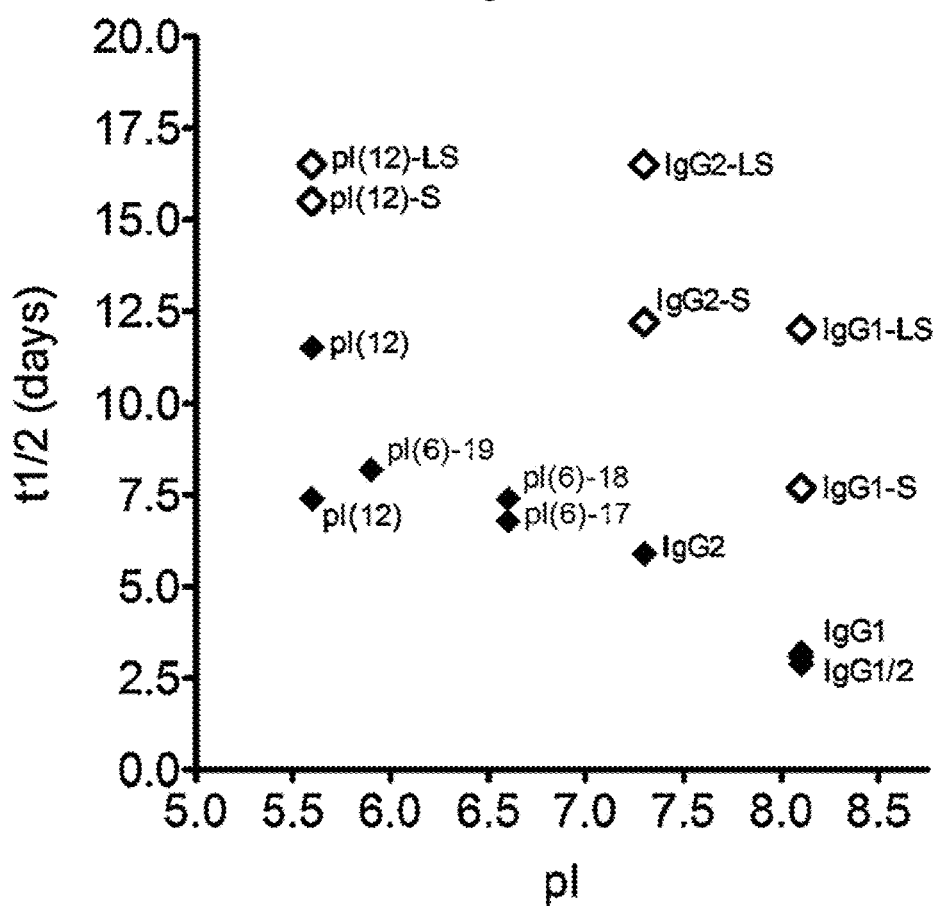
FIG. 23. Correlation between half-life and isoelectric point (pI) of native bevacizumab antibodies, pI-engineered variant versions with reduced pI, and native and pI-engineered versions that incorporate Fc modifications that improve binding to human FcRn.

The results indicate that both reducing positive charge and increasing negative charge contribute to improved half-life. In addition, the results indicate that engineered lower pI and increased binding to FcRn can be used in combination to obtain even greater enhancements in half-life. A plot of the half-life vs. pI relationship is provided in FIG. 23 for variant and native IgG's of identical Fv (bevacizumab) that have been tested in the huFcRn mice. The graph illustrates again the inverse relationship between half-life and pI, as well as the combinability of variants engineered for lower pI and Fc variants that improve binding to FcRn.

Example 6. New pI-Engineered Constructs

As described above, efforts can be made to minimize the risk that substitutions that lower pI will elicit immunogenicity by utilizing the isotypic differences between the IgG subclasses (IgG1, IgG2, IgG3, and IgG4). A new set of novel isotypes was designed based on this principal. Again, because immune recognition occurs at a local sequence level, i.e. MHC II and T-cell receptors recognize epitopes typically 9 residues in length, pI-altering substitutions were accompanied by isotypic substitutions proximal in sequence. In this way, epitopes were extended to match a natural isotype. Such substitutions would thus make up epitopes that are present in other human IgG isotypes, and thus would be expected to be tolerized.

Figure 25:
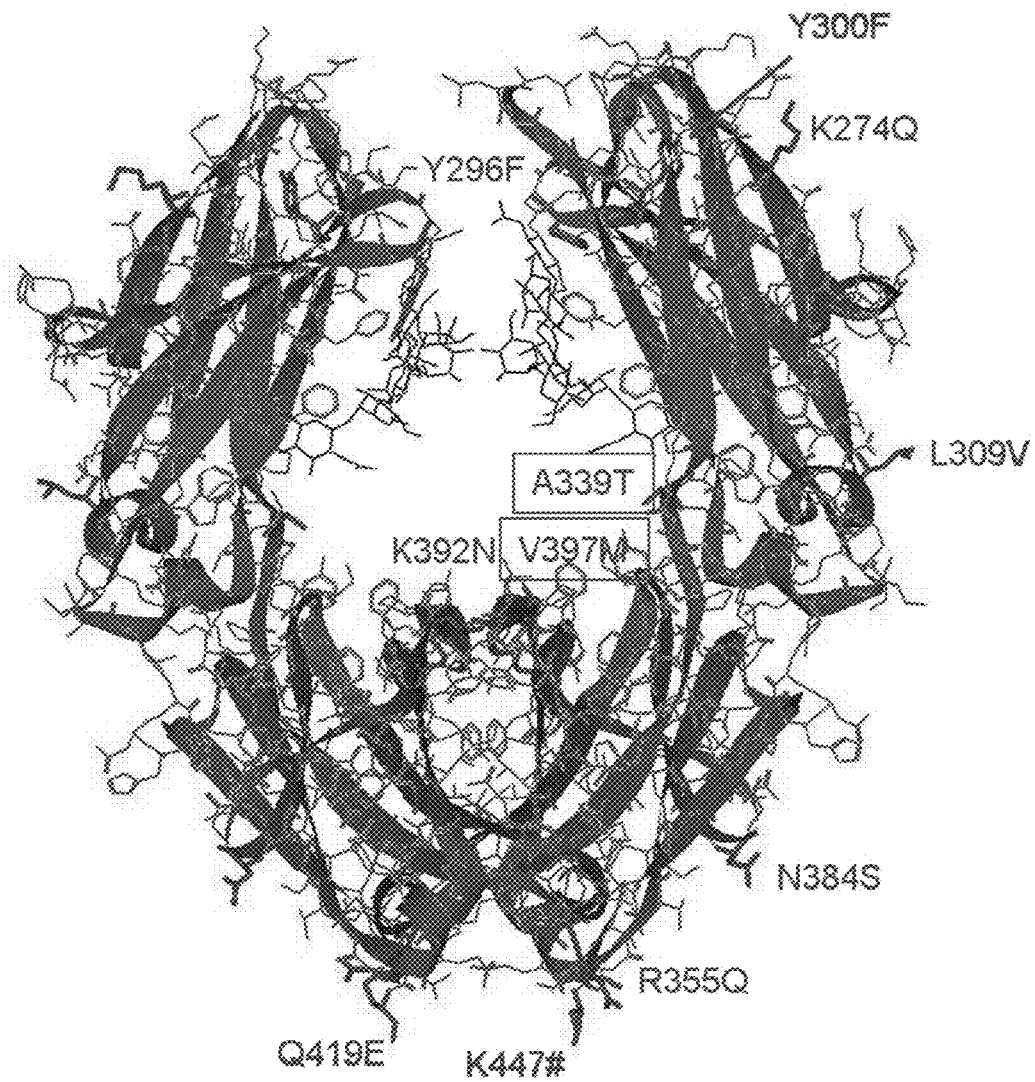
FIG. 25. D[SEQ ID NOS: 416-417] Differences between IgG1 and IgG-pI-Iso3 in the hinge and Fc region.
Figure 26:
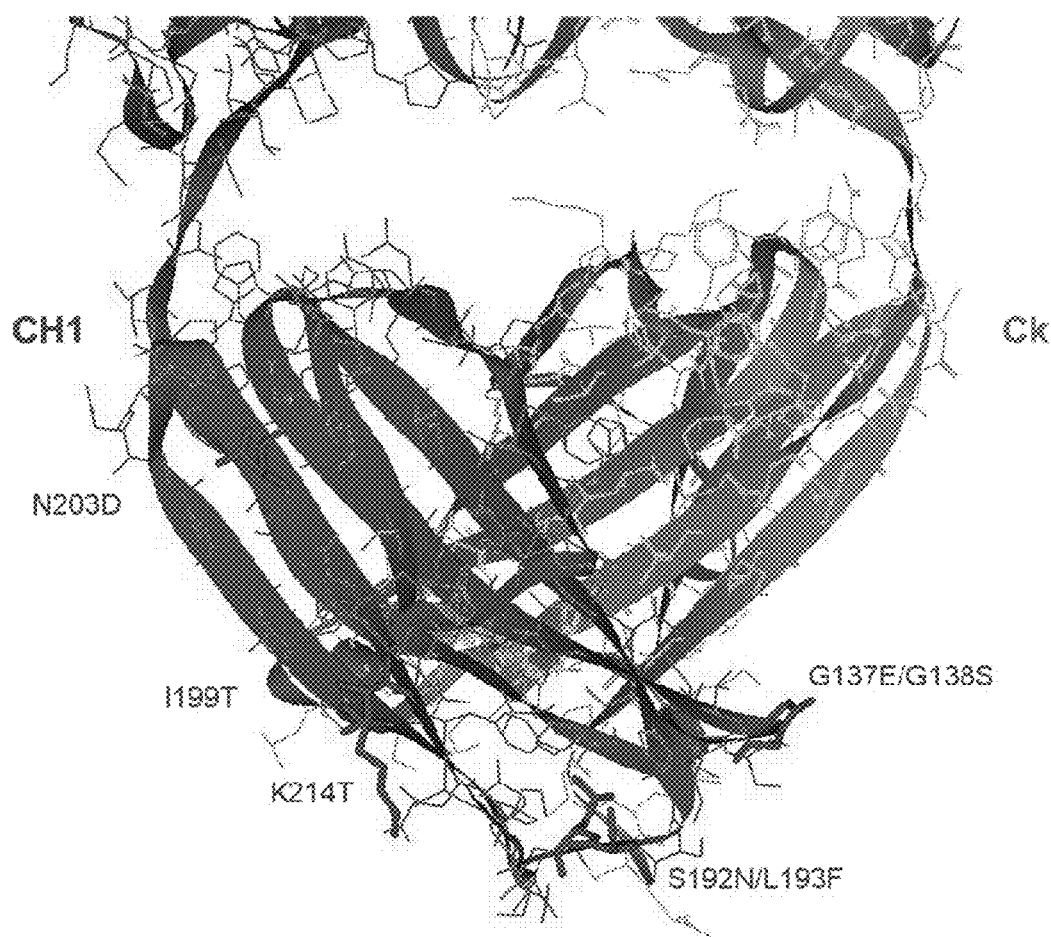
FIG. 26. Differences between IgG1 and IgG-pI-Iso3 in the CH1 region.

The designed low-pI isotypes, referred to as IgG-pI-Iso2, IgG-pI-Iso2-SL, IgG-pI-Iso2-charges-only, IgG-pI-Iso3, IgG-pI-Iso3-SL, and IgG-pI-Iso3-charges-only are described in Table 5, along with their pI and effector function properties. FIG. 24 provides a sequence alignment of IgG-pI-Iso3 with the native IgG isotypes, and depicts residue identities and residues that reduce pI relative to one or more of the native IgG isotypes. FIGS. 25 and 26 illustrate the structural differences between IgG1 and IgG-pI-Iso3. IgG-pI-Iso2, IgG-pI-Iso2-SL, and IgG-pI-Iso2-charges-only were designed to have low (weak) effector function, as determined by IgG2-like residues in the hinge (233P, 234V, 235A) and CH2 domain (327G). IgG-pI-Iso3, IgG-pI-Iso3-SL, and IgG-pI-Iso3-charges-only were designed to have high (strong) effector function, as determined by IgG1-like residues in the hinge (233E, 234L, 235L, 236G) and CH2 domain (327A). Isotypic low pI variants with the "SL" designation indicate that these variants differ from IgG-pI-Iso2 and IgG-pI-Iso3 by having 192S and 193L. Serine and leucine at these positions were found to be more compatible than 192N/193F due to differences in neighboring residues that are present in IgG1 and IgG2. Low pI isotype variants designated as "charges only" contain charge affecting isotypic substitutions, but do not contain the neighboring non-charge altering substitutions. The novel isotypes can be combined with a native light chain constant region (Ckappa or Clambda), or a variant version engineered with substitutions to further reduce the pI. An example of a pI-engineered light constant chain is a new variant referred to as CK-pI(4), described schematically in FIG. 27. In addition, the novel isotypes can be engineered with Fc variants that improve affinity to FcRn, thereby further enabling extended half-life. Such Fc variants may include, for example 434S or 428L/434S as described in Table 5, or other Fc variants as described herein. Amino acid sequences of IgG-pI-Iso2, IgG-pI-Iso2-SL, IgG-pI-Iso2-charges-only, IgG-pI-Iso3, IgG-pI-Iso3-SL, IgG-pI-Iso3-charges-only and CK-pI(4) are provided in FIG. 28.

TABLE 5

Novel IgG isotypes with low pI

| XENP | Heavy | Light | Fc variant | pI | Effector Function |
|---|---|---|---|---|---|
| 10178 | IgG-pI-Iso2 | WT | | 6.3 | Low |
| 10470 | IgG-pI-Iso2-SL | WT | | 6.3 | Low |
| 10180 | IgG-pI-Iso2 | WT | 434S | 6.3 | Low |
| 10471 | IgG-pI-Iso2-SL | WT | 434S | 6.3 | Low |
| 10182 | IgG-pI-Iso2 | CK-pI(4) | | 5.6 | Low |
| 10184 | IgG-pI-Iso2 | CK-pI(4) | 434S | 5.6 | Low |
| 10427 | IgG-pI-Iso2-charges-only | WT | | 6.3 | Low |
| 10473 | IgG-pI-Iso2-charges-only | WT | 434S | 6.3 | Low |
| 10179 | IgG-pI-Iso3 | WT | | 6.2 | High |
| 10286 | IgG-pI-Iso3-SL | WT | | 6.2 | High |
| 10181 | IgG-pI-Iso3 | WT | 434S | 6.2 | High |
| 10466 | IgG-pI-Iso3-SL | WT | 434S | 6.2 | High |
| 10467 | IgG-pI-Iso3-SL | WT | 428L/434S | 6.2 | High |
| 10183 | IgG-pI-Iso3 | CK-pI(4) | | 5.5 | High |
| 10185 | IgG-pI-Iso3 | CK-pI(4) | 434S | 5.5 | High |
| 10525 | IgG-pI-Iso3-SL | CK-pI(4) | 434S | 5.5 | High |
| 10426 | IgG-pI-Iso3-charges-only | WT | | 6.2 | High |
| 10472 | IgG-pI-Iso3-charges-only | WT | 434S | 6.2 | High |

SL = 192S/193L
CK-pI(4) = K126E/K145E/K169E/K207E
pI calculated with Fv = Bevacizumab The novel engineered isotypes can be combined with other Fc variants to generate antibodies or Fc fusions with extended half-life and other improved properties. For example, IgG-pI-Iso2-SL and/or IgG-pI-Iso3-SL may incorporate variants 239D, 332E, 267E, and/or 328F that modulate binding to FcγRs to provide enhanced effector function or immunomodulatory properties. The novel isotypes may be combined with other Fc variants that improve binding to FcRn, including for example 428L, 428L/434S, T250Q/M428L, M252Y/S254T/T256E, and N434A/T307Q, thereby potentially further extending in vivo half-life. Exemplary heavy chains are described in Table 6. Such variants may be expressed with a light chain that has a native constant light chain (CK or Cλ), or one that also incorporates constant light chain modifications that reduce pI, including for example any of the engineered constant light chains described herein, including for example CK-pI(4).

TABLE 6

Engineered combinations of pI isotype variants with other variants.

| Heavy | Fc |
|---|---|
| IgG-pI-Iso3-SL | 332E |
| IgG-pI-Iso3-SL | 239D/332E |
| IgG-pI-Iso3-SL | 332E/434S |
| IgG-pI-Iso3-SL | 239D/332E/434S |
| IgG-pI-Iso2-SL | 267E/328F |
| IgG-pI-Iso2-SL | 434S/267E/328F |
| IgG-pI-Iso3-SL | 267E/328F |
| IgG-pI-Iso3-SL | 434S/267E/328F |
| IgG-pI-Iso2-SL | 428L/434S |
| IgG-pI-Iso3-SL | 428L/434S |
| IgG-pI-Iso2-SL | 428L |
| IgG-pI-Iso3-SL | 428L |
| IgG-pI-Iso2-SL | 250Q/428L |
| IgG-pI-Iso3-SL | 250Q/428L |

TABLE 6-continued

Engineered combinations of pI isotype variants with other variants.

| Heavy | Fc |
|---|---|
| IgG-pI-Iso2-SL | 252Y/254T/256E |
| IgG-pI-Iso3-SL | 252Y/254T/256E |
| IgG-pI-Iso2-SL | 434A/307Q |
| IgG-pI-Iso3-SL | 434A/307Q |

Figure 30:
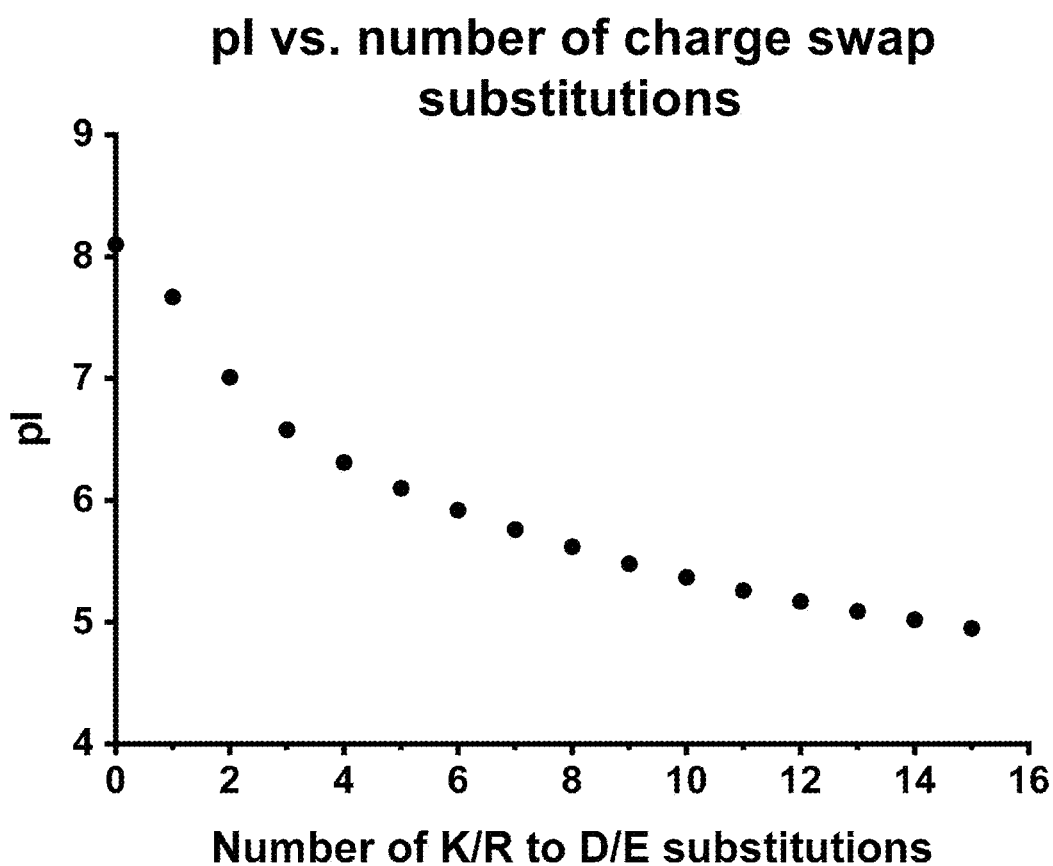
FIG. 30. Plot showing the effect of charge swap mutations on antibody pI. As the pI gets lower the change in pI per charge swap decreases.

In order to reduce pI even further, additional variant heavy constant chains with reduced pI were designed to minimize mutational load by introducing charge swapping mutations, i.e. where K and R were replaced with D or E, as described above. To aid in the design of these variants, fraction exposed as well as the energy change upon substitution to Glu were calculated for each K and R residue in the Fc region (FIG. 29). These new variants are referred to as pI(7) and pI(11). pI(7) incorporated amino acid modifications K133E, K205E, K210E, K274E, R355E, K392E, and a deletion of the Lys at 447, and pI(11) incorporated amino acid modifications K133E, K205E, K210E, K274E, K320E, K322E, K326E, K334E, R355E, K392E, and a deletion of the Lys at 447 These modifications were introduced into heavy constant chains to result in antibodies with strong effector function, IgG1-pI(7) and IgG1-pI(11), and weak effector function IgG1/2-pI(7) and IgG1/2-pI(11). As can be seen in FIG. 30, as mAb pI gets lower, it requires a greater number of charge swap substitutions to decrease pI further. These pI-engineered variants are described in Table 7, and amino acid sequences are provided in FIG. 28.

TABLE 7

Engineered charge swaps

| XENP | Heavy | Fc variant | Light | pI |
|---|---|---|---|---|
| 10107 | IgG1-pI(7) | | CK-pI(4) | 5.3 |
| 10108 | IgG1-pI(11) | | CK-pI(4) | 5.0 |
| 10109 | IgG1/2-pI(7) | | CK-pI(4) | 5.4 |
| 10110 | IgG1/2-pI(11) | | CK-pI(4) | 5.0 |
| 10476 | IgG1/2-pI(7) | 434S | CK-pI(4) | 5.4 |

Figure 31:
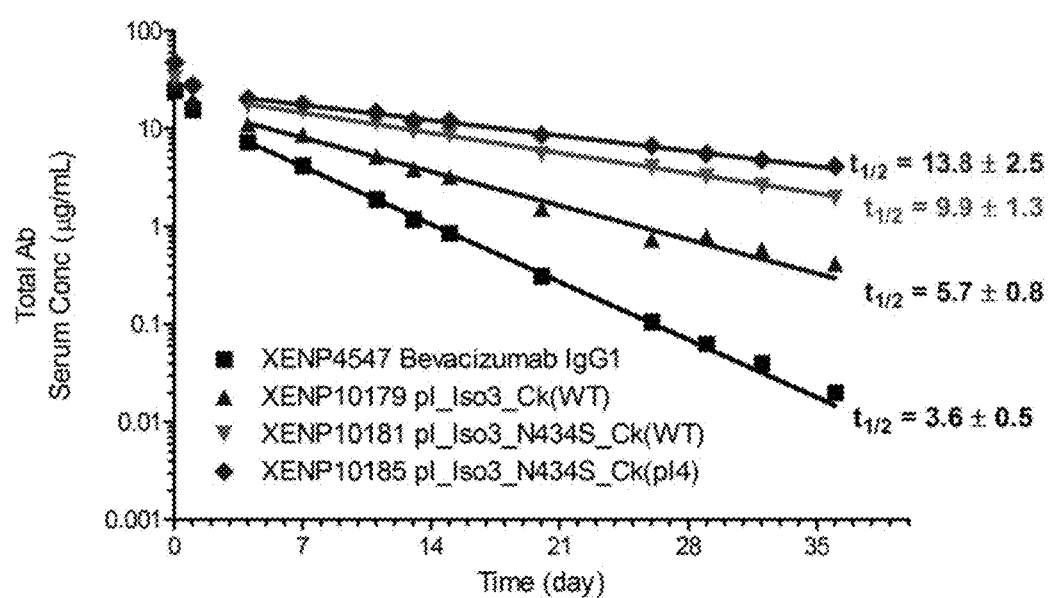
FIG. 31. PK results of pI-engineered isotypic variant bevacizumab antibodies (IgG-pI-Iso3) and combinations with substitution N434S in huFcRn mice.
Figure 32:
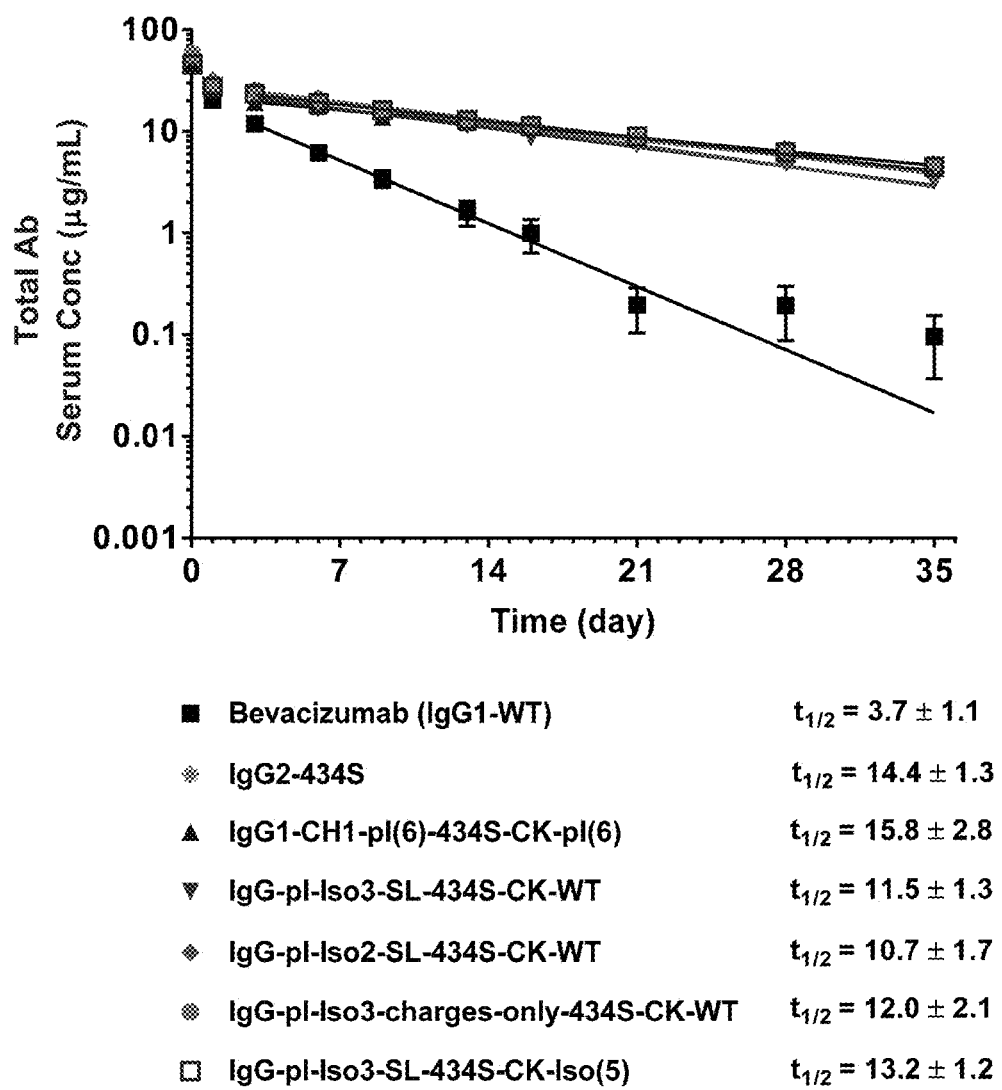
FIG. 32. PK results of pI-engineered isotypic variant bevacizumab antibodies and combinations with substitution N434S in huFcRn mice.
Figure 33:
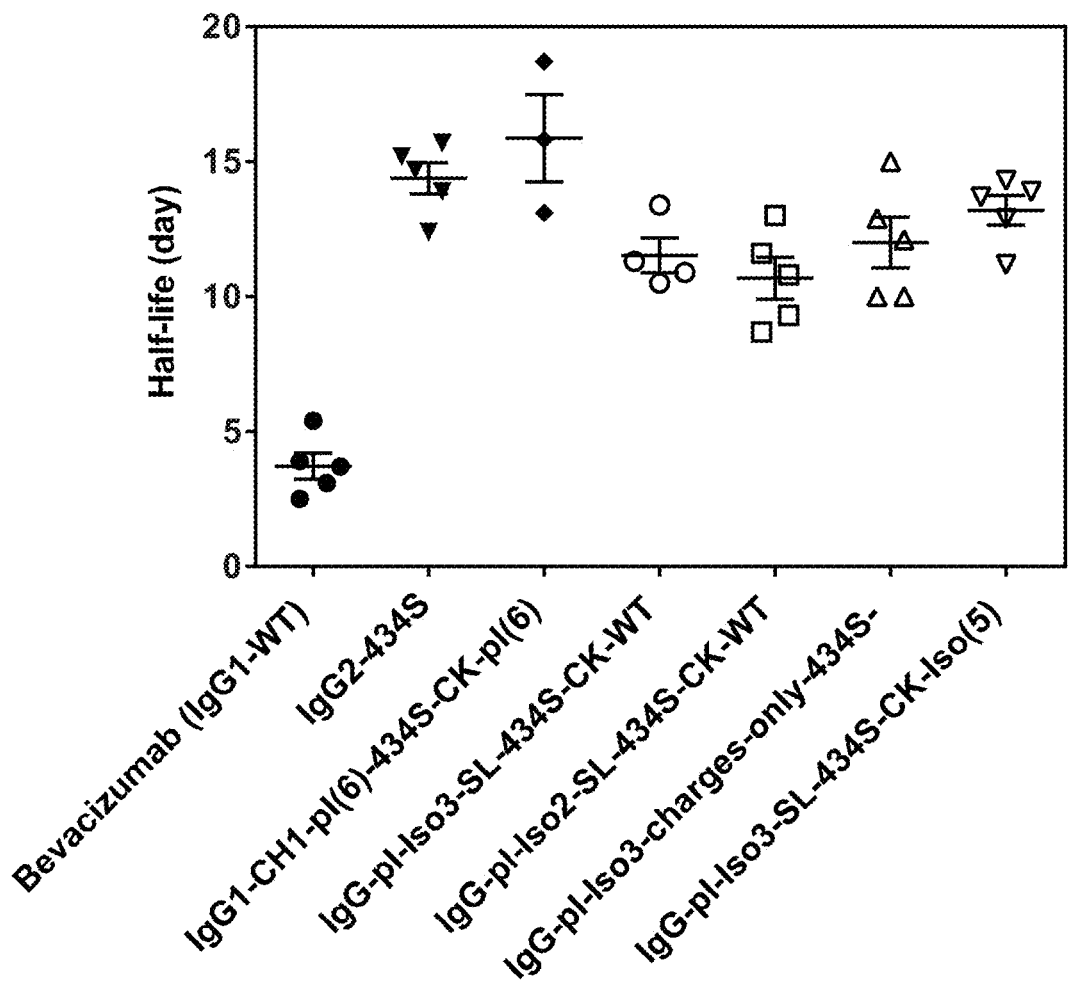
FIG. 33. Scatter plot of PK results of pI-engineered isotypic variant bevacizumab antibodies and combinations with substitution N434S in huFcRn mice. Each point represents a single mouse from the study. It should be noted that the 428L substitution can also be added to each of these pI antibodies.

IgG1-pI(7) = K133E/K205E/K210E/K274E/R355E/K392E/K447#
IgG1-pI(11) = K133E/K205E/K210E/K274E/K320E/K322E/K326E/K334E/R355E/K392E/K447#
IgG1/2-pI(7) = K133E/K205E/K210E/Q274E/R355E/K392E/K447#
IgG1/2-pI(11) = K133E/K205E/K210E/Q274E/K320E/K322E/K326E/K334E/R355E/K392E/K447#
CK-pI(4) = K126E/K145E/K169E/K207E
pI calculated with Fv = Bevacizumab Antibody variants were constructed with the variable region of bevacizumab using molecular biology techniques as described above. Antibodies were expressed, purified, and characterized as described above. PK studies of the variant and control antibodies were carried out in the huFcRn mice as described above. The group mean averages of the serum concentrations are plotted in FIG. 31 and FIG. 32, along with the half-lives obtained from the fits of the data. Half-lives for individual mice are plotted in FIG. 33. The data clearly demonstrate the additivity of low pI from isotypic pI variants as well as enhanced FcRn binding from the N434S substitution as shown by a plot of half-life vs. pI as shown in FIG. 34.

Example 7. Isotypic Light Chain Constant Region Variants

Figure 35:
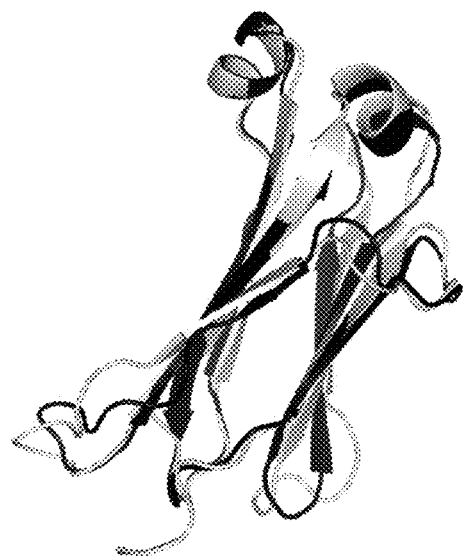
FIG. 35. Structural alignment of CK and C-lambda domains.

Homology between CK and Cλ is not as high as between the IgG subclasses (as shown in FIG. 18), however the sequence and structural homology that exists may still be used to guide substitutions to create an isotypic low-pI light chain constant region. In FIG. 18, positions with residues contributing to a higher pI (K, R, and H) or lower pI (D and E) are highlighted in bold. Gray indicates lysine, arginines, and histidines that may be substituted, preferably with aspartic or glutatmic acids, to lower the isoelectric point. A structural alignment of CK and Cλ was constructed (FIG. 35) and used along with the sequence alignment as a guide to make several CK/Cλ isotypic variants. These pI-engineered variants are described in Table 8, and amino acid sequences are provided in FIG. 28.

TABLE 8

Engineered low-pI variants containing isotypic light chain constant regions

| XENP | Heavy | Light | Fc variant | pI | Effector Function |
|---|---|---|---|---|---|
| 10324 | IgG-pI-Iso3 | CK-Iso(3) | | 5.9 | High |
| 10325 | IgG-pI-Iso3 | CK-Iso(4) | | 5.8 | High |
| 10326 | IgG-pI-Iso3 | CK-Iso(5) | | 5.8 | High |
| 10327 | IgG-pI-Iso3 | CK-Iso(6) | | 5.7 | High |
| 10511 | IgG-pI-Iso3-SL | CK-Iso(3) | | 5.9 | High |
| 10512 | IgG-pI-Iso3-SL | CK-Iso(4) | | 5.8 | High |
| 10513 | IgG-pI-Iso3-SL | CK-Iso(5) | | 5.8 | High |
| 10517 | IgG-pI-Iso3-SL | CK-Iso(3) | 434S | 5.9 | High |
| 10518 | IgG-pI-Iso3-SL | CK-Iso(4) | 434S | 5.8 | High |
| 10519 | IgG-pI-Iso3-SL | CK-Iso(5) | 434S | 5.8 | High |
| 10520 | IgG-pI-Iso3-SL | CK-Iso(3) | 428L/434S | 5.9 | High |
| 10521 | IgG-pI-Iso3-SL | CK-Iso(4) | 428L/434S | 5.8 | High |
| 10522 | IgG-pI-Iso3-SL | CK-Iso(5) | 428L/434S | 5.8 | High |
| 10526 | IgG-pI-Iso3 | CK-Iso(5) | 434S | 5.8 | High |
| 10527 | IgG-pI-Iso2-SL | CK-Iso(5) | 434S | 5.8 | Low |

Antibody variants were constructed with the variable region of bevacizumab using molecular biology techniques as described above. Antibodies were expressed, purified, and characterized as described above. PK studies of the variant and control antibodies were carried out in the huFcRn mice as described above. The group mean averages of the serum concentrations as well as the half-lives obtained from fits of the data for one of these variants (XENP10519-IgG-pI-Iso3-SL-434S-CK-Iso(5)) are plotted in FIG. 32 and the half-lives for individual mice in FIG. 33. This variant is also included in the correlation plot shown in FIG. 34. The benefit of lower pI due to the CK-Iso(5) light chain is clearly shown.

Example 8. Purifying Mixtures of Antibody Variants with Modified Isoelectric Points Substitutions that modify the antibody isoelectric point may be introduced into one or more chains of an antibody variant to facilitate analysis and purification. For instance, heterodimeric antibodies such as those disclosed in US2011/0054151A1 can be purified by modifying the isoelectric point of one chain, so that the multiple species present after expression and Protein A purification can be purified by methods that separate proteins based on differences in charge, such as ion exchange chromatography. An overview of the process using two different heavy chains—one unmodified IgG1, and one with modified isoelectric point, is shown in FIG. 38.

As an example, the heavy chain of bevacizumab was modified by introducing subsitutions to lower its isoelectric point such that the difference in charges between the three species produced when WT-IgG1-HC, low-pI-HC, and WT-LC are transfected in 293E cells is large enough to facilitate purification by anion exchange chromatography. Clones were created as described above, and transfection and initial purification by Protein A chromatography is also as described above. Sequences of the three chains are listed in FIG. 39 as "Heavy chain 1 of XENP10653", "Heavy chain 2 of XENP10653", and "Light chain of XENP10653". After Protein A purification, three species with nearly identical molecular weights but different charges are obtained. These are the WT-IgG1-HC/WT-IgG1-HC homodimer (pI=8.12), WT-IgG1-HC/low-pI-HC heterodimer (pI=6.89), and low-pI-HC/low-pI-HC homodimer (pI=6.20). The mixture was loaded onto a GE HITRAP® Q HP column in 20 mM Tris, pH 7.6 and eluted with a step-wise gradient of NaCl consisting of 50 mM, 100 mM, and finally 200 mM NaCl in the same Tris buffer. Elution was monitored by A280, and each fraction analyzed on Invitrogen pH 3-10 IEF gels with NOVEX® running buffer and these results are shown in FIG. 40. WT-IgG1-HC/WT-IgG1-HC homodimer does not bind to the anion exchange column at pH 7.6 and is thus present in the flowthrough and wash (lanes 1-2). The desired heterodimer elutes with 50 mM NaCl (lane 3), while the low-pI-HC/low-pI-HC homodimer binds tightest to the column and elutes at 100 (lane 4) and 200 mM (lane 5) NaCl. Thus the desired heterodimer variant, which is difficult to purify by other means because of its similar molecular weight to the other two species, is easily purified by the introduction of low pI substitutions into one chain. This method of purifying antibodies by engineering the isoelectric point of each chain can be applied to methods of purifying various bispecific antibody constructs as outlined in FIG. 41 and FIG. 42. The method is particularly useful when the desired species in the mixture has similar molecular weight and other properties such that normal purification techniques are not capable of separating the desired species in high yield. Specific heterodimeric and/or bispecific constructs and sequences with isoelectric points engineered for easy purification are shown in Tables 9 and 10, and FIG. 39, respectively.

TABLE 9

Heterodimeric and/or bispecific constructs with isoelectric points engineered for easy purification and list of isoelectric points.

| | Calculated pI | | |
|---|---|---|---|
| Protein | Low pI Homodimer | Hetero-dimer | High pI Homodimer |
| XENP10653 | 6.20 | 6.87 | 8.02 |
| Anti-HER2 × anti-CD16 mAb-Fv | 6.07 | 7.31 | 8.47 |
| Anti-CD19 × anti-CD16 mAb-Fv | 5.84 | 6.63 | 8.21 |
| Anti-CD19 × anti-CD32b mAb-Fv | 6.23 | 6.74 | 7.80 |
| Anti-CD40 × anti-CD32b mAb-Fv | 6.54 | 7.46 | 8.22 |
| Anti-HER2 × anti-CD3 mAb-Fv | 7.58 | 8.21 | 8.52 |
| Anti-HER2 × anti-CD3 scFv-Fc | 7.31 | 8.31 | 8.69 |

TABLE 10

Heterodimeric and/or bispecific constructs with isoelectric points engineered for easy purification and list of charge state at pH 7.4.

| | Calculated charge state at pH 7.4 | | |
|---|---|---|---|
| Protein | Low pI Homodimer | Hetero-dimer | High pI Homodimer |
| XENP10653 | −12.57 | −3.59 | +5.40 |
| Anti-HER2 × anti-CD16 mAb-Fv | −16.67 | −0.65 | +15.37 |
| Anti-CD19 × anti-CD16 mAb-Fv | −22.68 | −6.66 | +9.36 |
| Anti-CD19 × anti-CD32b mAb-Fv | −14.53 | −5.59 | +3.35 |

TABLE 10-continued

Heterodimeric and/or bispecific constructs with
isoelectric points engineered for easy purification
and list of charge state at pH 7.4.

| | Calculated charge state at pH 7.4 | | |
|---|---|---|---|
| Protein | Low pI Homodimer | Hetero-dimer | High pI Homodimer |
| Anti-CD40 × anti-CD32b mAb-Fv | −8.51 | +0.43 | +9.37 |
| Anti-HER2 × anti-CD3 mAb-Fv | +1.25 | +9.32 | +17.40 |
| Anti-HER2 × anti-CD3 scFv-Fc | −0.34 | +6.68 | +13.71 |

Example 9. Design of Non-Native Charge Substitutions to Alter pI

The pI of antibody constant chains were altered by engineering substitutions in the constant domains. Reduced pI can be engineered by making substitutions of basic amino acids (K or R) to acidic amino acids (D or E), which result in the largest decrease in pI. Mutations of basic amino acids to neutral amino acids and neutral amino acids to acidic amino acids will also result in a decrease in pI. Conversely, increased pI can be engineered by making substitutions of acidic amino acids (D or E) to basic amino acids (K or R), which result in the largest increase in pI. Mutations of acidic amino acids to neutral amino acids and neutral amino acids to basic amino acids will also result in a increase in pI. A list of amino acid pK values can be found in Table 1 of Bjellqvist et al., 1994, Electrophoresis 15:529-539.

In deciding which positions to mutate, the surrounding environment and number of contacts the WT amino acid makes with its neighbors was taken into account such as to minimize the impact of a substitution or set of substitutions on structure and/or function. The solvent accessibility or fraction exposed of each constant region position was calculated using relevant crystal structures. The results are shown in FIG. 43. Based on this analysis, a number of substitutions were identified that reduce or increase pI but are predicted to have minimal impact on the biophysical properties of the domains. Proof of concept results in the context of bevacizumab are shown in FIGS. 44-47 (heavy chain) and FIGS. 48-51 (light chain).

Calculation of protein pI was performed as follows. First, a count was taken of the number of D, E, C, H, K, R, and Y amino acids as well as the number of N- and C-termini present in the protein. Then, the pI was calculated by identifying the pH for which the protein has an overall charge of zero. This was done by calculating the net charge of the protein at a number of test pH values. Test pH values were set in an iterative manner, stepping up from a low pH of 0 to a high pH of 14 by increments of 0.001 until the charge of the protein reached or surpassed zero. Net charge of a protein at a given pH was calculated by the following formula:

$$q_{protein}(pH) = \sum_{i=H,K,R,Ntermini} \frac{N_i}{1 + 10^{pH-pK_i}} - \sum_{i=D,E,C,Y,Ctermini} \frac{N_i}{1 + 10^{pK_i-pH}}$$

where $q_{protein}(pH)$ is the net charge on the protein at the given pH, $N_i$ is the number of amino acid i (or N- or C-termini) present in the protein, and $pK_i$ is the pK of amino acid i (or N- or C-termini).

Example 10. Isotypic Constant Region Variants

As described above, efforts can be made to minimize the risk that substitutions that increase or decrease pI will elicit immunogenicity by utilizing the isotypic differences between the IgG subclasses (IgG1, IgG2, IgG3, and IgG4). A new set of novel isotypes was designed based on this principal. If possible, pI-altering substitutions were accompanied by isotypic substitutions proximal in sequence. In this way, epitopes were extended to match a natural isotype. Such substitutions would thus make up epitopes that are present in other human IgG isotypes, and thus would be expected to be tolerized. These new variants are called ISO(−), ISO(+), and ISO(+RR). ISO(−) has reduced pI while ISO(+) and ISO(+RR) have increased pI. A sequence alignment showing the isotypic variation in IgG1, IgG2, IgG3, and IgG4 as well as the sequences of the new isotypic pI variants are shown in FIG. 52. The sequences of these new variants are also shown in isolation and in the context of an anti-VEGF antibody (FIGS. 53-57). All possible combinations of pI lowering isotypic mutations from IgG1, IgG2, IgG3, and IgG4 are shown in FIG. 58. All possible combinations of pI increasing isotypic mutations are shown in FIG. 59.

Example 11. Purifying Mixtures of Antibody Variants with Modified Isolectric Points As mentioned previously, substitutions that modify the antibody isoelectric point may be introduced into one or more chains of an antibody variant to facilitate analysis and purification. This is especially useful when a preparation of antibody contains a mixture of very similar species as in the case of heterodimeric and/or bispecific constructs that produce a mixture of hetero- and homodimers. In order to demonstrate purification of a nearly identical antibody heterodimer species from the corresponding homodimers, we constructed our isotypic pI variants in the context of the antibody bevacizumab. Variants were constructed by transfecting two different heavy chain DNAs (ISO(−), ISO(+), ISO(+RR), or IgG1(WT)) with the bevacizumab light chain. Variants were first purified by Protein A, and then loaded onto a GE Healthcare HITRAP® SP HP cation exchange column in 50 mM MES (pH 6.0) and eluted with an NaCl gradient. Following elution, fractions from each peak were loaded onto a LONZA® ISOGEL™ IEF plate (pH range 7-11) for analysis. Data are shown in FIGS. 60-63. As can be seen from the data, separation of the middle pI heterodimer is achieved in each case, with separation improved when the heterodimer has a larger difference in pI from the homodimers.

Example 12. Design of Mixtures of Immunoglobulin Variants with Modified Isoelectric Points This method of purifying antibodies by engineering the isoelectric point of each chain can be applied to methods of purifying various bispecific antibody constructs. The method is particularly useful when the desired species in the mixture has similar molecular weight and other properties such that normal purification techniques are not capable of separating the desired species in high yield. A schematic of a generic heterodimeric immunoglobulin variant is shown in FIG. 64. Heterodimeric immunoglobulin variants may include VH or VL variable regions in one or more of their chains. Some examples of VH and VL regions that can be used in the construction of heterodimeric immunoglobulin variants are listed in FIG. 65. Specific heterodimeric and/or bispecific constructs and sequences with isoelectric points engineered for easy purification are shown in FIGS. 66-79.

Example 13. Purifying Mixtures of Bispecific Immunoglobulin Variants with Modified Isolectric Points In order to further demonstrate purification of a nearly identical bispecific heterodimer species from the corresponding homodimers, we constructed our isotypic pI variants in the context of an anti-CD19 x anti-CD3 dual scFv-Fc (XENP11355, see FIG. 80), an anti-CD19 x anti-CD32b dual scFv-Fc (XENP11139, see FIG. 82), and a second anti-CD19 x anti-CD3 dual scFv-Fc (XENP11338, see FIG. 84). Variants were constructed by co-transfecting two different heavy chain DNAs (ISO(−), ISO(+), or ISO(+RR)). Variants were first purified by Protein A, and then loaded onto a GE Healthcare HITRAP® SP HP cation exchange column in 50 mM MES (pH 6.0) and eluted with an NaCl gradient. Following elution, fractions from each peak were loaded onto a LONZA® ISOGEL™ IEF plate (pH range 3-10) for analysis. Data are shown in FIGS. 81, 83, and 85. As can be seen from the data, efficient separation of the middle pI heterodimer is achieved in each case.

Example 14. Purifying Mixtures of Monospecific, Monovalent Immunoglobulin Variants with Modified Isolectric Points In order to further demonstrate purification of a nearly identical monospecific, monovalent heterodimer species from the corresponding homodimers, we constructed our isotypic pI variants in the context of an anti-CD40 monovalent mAb (XENP11233, see FIG. 86) and an one-arm anti-CD40 mAb (XENP11238, see FIG. 88). Variants were constructed by co-transfecting two different heavy chain DNAs (ISO(−), ISO(+), or ISO(+RR)). Variants were first purified by Protein A, and then loaded onto a LONZA® ISOGEL™ IEF plate (pH range 3-10) for analysis. Data are shown in FIGS. 86 and 88. As can be seen from the data, efficient separation of the middle pI heterodimer is achieved in each case.

SEQUENCE LISTING (442 sequences)

SEQ ID NO: 1 - protein, 106 aa, Artificial Sequence
  Kappa constant light chain (CK)  (Figure 1)
RTVAAPSVFIFPPSDEQLKSGTASWCLLNNFYPREAKVQWKVDNALQSGNSQESVTEQDSKDSTYSLSSTLTLSKADYEKHKVYACEVTHQGLSSPVTKSFNRGEC

SEQ ID NO: 2 - protein, 330 aa, Artificial Sequence
  lgG1 constant heavy chain (CH1-hinge-CH2-CH3)  (Figure 1)
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3 - protein, 325 aa, Artificial Sequence
  lgG2 constant heavy chain (CH1-hinge-CH2-CH3)  (Figure 1)
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVWDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 4 - protein, 377 aa, Artificial Sequence
  lgG3 constant heavy chain (CH1-hinge-CH2-CH3)  (Figure 1)
ASTKGPSVFPLAPCSRSTSGGTAALGCLVKDYFPEPVTVSWNSGALTSGVHTFPAVLQSSGLYSLSSVVTVPSSSLGTQTYTCNVNHKPSNTKVDKRVELKTPLGDTTHTCPRCPEPKSCDTPPPCPRCPEPKSCDTPPPCPRCPEPKSCDTPPPCPRCPAPELLGGPSVFLFPPKPKDTLMISRTPEVTCVVVDVSHEDPEVQFKWYVDGVEVHNAKTKPREEQYNSTFRVVSVLTVLHQDWLNGKEYKCKVSNKALPAPIEKTISKTKGQPREPQVYTLPPSREEMTKNQVSLTCLVKGFYPSDIAVEWESSGQPENNYNTTPPMLDSDGSFFLYSKLTVDKSRWQQGNIFSCSVMHEALHNRFTQKSLSLSPGK

SEQ ID NO: 5 - protein, 326 aa, Artificial Sequence
  lgG4 constant heavy chain (CH1-hinge-CH2-CH3)  (Figure 1)
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVWDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 6 - protein, 328 aa, Artificial Sequence
  lgG1/2 constant heavy chain (CH1-hinge-CH2-CH3)  (Figure 1)
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVSHEDPEVQFNWYVDGVEVHNAKTKPREEQFNSTFRWSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 7 - protein, 329 aa, Artificial Sequence
  lgG1-CH1-pl(6)  (Figure 4)
AETKGPSVFPLAPSSESTSGGTAALGCLVKDYFPEPVTVSWNSGALESGVHTFPAVLQSSGLYSLSSVVTVPSSSLGTQTYICNVNHEPSDTEVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQWTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 8 - protein, 107 aa, Artificial Sequence
  CK-pl(6)  (Figure 4)
RTVAAPSVFIFPPSDEQLESGTASVVCLLNNFYPREAEVQWKVDDALQEGNSQESVTEQDSEDSTYSLSSTLTLSKADYEKHKVYACEVTHQGLESPVTKSFNRGEC

SEQ ID NO: 9 - protein, 123 aa, Artificial Sequence [sequence omitted]

SEQ ID NO: 10 - protein, 107 aa, Artificial Sequence [sequence omitted]

SEQ ID NO: 11 - protein, 453 aa, Artificial Sequence
  Heavy chain of XENP9493 Bevacizumab-lgG1-CH1-pi(6)-CK-pl(6) (Figure 6)
EVQLVESGGGLVQPGGSLRLSCAASGYTFTNYGMNWVRQAPGKGLEWVGWINTYTGEPTYAADFKRRFTFSLDTSKSTAYLQMNSLRAEDTAVYYCAKYPHYYGSSHWYFDVWGQGTLVTVSSAETKGPSVFPLAPSSESTSGGTAALGCLVKDYFPEPVTVSWNSGALESGVHTFPAVLQSSGLYSLSSVVTVPSSSLGTQTYICNVNHEPSDTEVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 12 - protein, 214 aa, Artificial Sequence
  Light chain of XENP9493 Bevacizumab-lgG1-CH1-pi(6)-CK-pl(6) (Figure 6)
DIQMTQSPSSLSASVGDRVTITCSASQDISNYLNWYQQKPGKAPKVLIYFTSSLHSGVPSRFSGSGSGTDFTLTISSLQPEDFATYYCQQYSTVPWTFGQGTKVEIKRTVAAPSVFIFPPSDEQLESGTASVVCLLNNFYPREAEVQWKVDDALQEGNSQESVTEQDSEDSTYSLSSTLTLSKADYEKHKVYACEVTHQGLESPVTKSFNRGEC

SEQ ID NO: 13 - protein, 328 aa, Artificial Sequence
  pl-iso1  (Figure 19)
ASTKGPSVFPLAPSSKSTSESTAALGCLVKDYFPEPVTVSWNSGALTSGVHTFPAVLQSSGLYSLSSVVTVPSSSLGTQTYTCNVDHKPSNTKVDKTVEPKSCDTTHTCPPCPAPELLGGPSVFLFPPKPKDTLMISRTPEVTCVWDVSQEDPEVQFNWYVDGVEVHNAKTKPREEQYNSTYRVVSVLTVLHQDWLNGKEYKCKVSNKALPAPIEKTISKAKGQPREPQVYTLPPSQEEMTKNQVSLTCLVKGFYPSDIAVEWESSGQPENNYNTTPPMLDSDGSFFLYSKLTVDKSRWQEGNVFSCSVMHEALHNHYTQKSLSLSPG

SEQ ID NO: 14 - protein, 329 aa, Artificial Sequence
  pl-iso1(NF)  (Figure 19)
ASTKGPSVFPLAPSSKSTSESTAALGCLVKDYFPEPVTVSWNSGALTSGVHTFPAVLQSSGLYSLSSVVTVPSSNFGTQTYTCNVDHKPSNTKVDKTVEPKSCDTTHTCPPCPAPELLGGPSVFLFPPKPKDTLMISRTPEVTCVVVDVSQEDPEVQFNWYVDGVEVHNAKTKPREEQYNSTYRVVSVLTVLHQDWLNGKEYKCKVSNKALPAPIEKTISKAKGQPREPQVYTLPPSQEEMTKNQVSLTCLVKGFYPSDIAVEWESSGQPENNYNTTPPMLDSDGSFFLYSKLTVDKSRWQEGNVFSCSVMHEALHNHYTQKSLSLSPG

SEQ ID NO: 15 - protein, 324 aa, Artificial Sequence
  pl-iso1 (NF-VE)  (Figure 19)
ASTKGPSVFPLAPSSKSTSESTAALGCLVKDYFPEPVTVSWNSGALTSGVHTFPAVLQSSGLYSLSSVVTVPSSNFGTQTYTCNVDHKPSNTKVDKTVEPKSCVECPPCPAPELLGGPSVFLFPPKPKDTLMISRTPEVTCVWDVSQEDPEVQFNWYVDGVEVHNAKTKPREEQYNSTYRVVSVLTVLHQDWLNGKEYKCKVSNKALPAPIEKTISKAKGQPREPQWTLPPSQEEMTKNQVSLTCLVKGFYPSDIAVEWESSGQPENNYNTTPPMLDSDGSFFLYSKLTVDKSRWQEGNVFSCSVMHEALHNHYTQKSLSLSPG

SEQ ID NO: 16 - protein, 328 aa, Artificial Sequence
  pl-iso1(NF-VE-DEDE)  (Figure 19)
ASTKGPSVFPLAPSSKSTSESTAALGCLVKDYFPEPVTVSWNSGALTSGVHTFPAVLQSSGLYSLSSVVTVPSSNFGTQTYTCNVDHKPSNTKVDKTVEPKSCVECPPCPAPELLGGPSVFLFPPKPKDTLMISRTPEVTCVWDVSQEDPEVQFNWYVDGVEVHNAKTKPREEQYNSTYRVVSVLTVLHQDWLNGKEYKCKVSNKALPAPIEKTISKAKGQPREPQWTLPPSQEEMTKNQVSLTCLVKGFYPSDIAVEWESSGQPENNYNTTPPMLDSDGSFFLYSKLTVDKSRWQEGNVFSCSVMHEALHNHYTQKSLSLSPGDEDE

SEQ ID NO: 17 - protein, 106 aa, Artificial Sequence
  CK-pl(3)  (Figure 20)
RTVAAPSVFIFPPSDEQLESGTASWCLLNNFYPREAEVQWKVDNALQSGNSQESVTEQDSEDSTYSLSSTLTLSKADYEKHKVYACEVTHQGLSSPVTKSFNRGEC

SEQ ID NO: 18 - protein, 110 aa, Artificial Sequence
  CK-pi(6-DEDE)  (Figure 20)
RTVAAPSVFIFPPSDEQLESGTASWCLLNNFYPREAEVQWKVDDALQEGNSQESVTEQDSEDSTYSLSSTLTLSKADYEKHKVYACEVTHQGLESPVTKSFNRGECDEDE

SEQ ID NO: 19 - protein, 325 aa, Artificial Sequence
  IgG-pi-Iso2  (Figure 28)
ASTKGPSVFPLAPSSKSTSESTAALGCLVKDYFPEPVTVSWNSGALTSGVHTFPAVLQSSGLYSLSSVVTVPSSNFGTQTYTCNVDHKPSNTKVDKTVEPKSCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSQEEMTKNQVSLTCLVKGFYPSDIAVEWESSGQPENNYNTTPPMLDSDGSFFLYSKLTVDKSRWQEGNVFSCSVMHEALHNHYTQKSLSLSPG

SEQ ID NO: 20 - protein, 325 aa, Artificial Sequence
  IgG-pI-Iso2-SL  (Figure 28)
ASTKGPSVFPLAPSSKSTSESTAALGCLVKDYFPEPVTVSWNSGALTSGVHTFPAVLQSSGLYSLSSVVTVPSSSLGTQTYTCNVDHKPSNTKVDKTVEPKSCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSQEEMTKNQVSLTCLVKGFYPSDIAVEWESSGQPENNYNTTPPMLDSDGSFFLYSKLTVDKSRWQEGNVFSCSVMHEALHNHYTQKSLSLSPG

SEQ ID NO: 21 - protein, 324 aa, Artificial Sequence
  IgG-pI-Iso2-charges-only  (Figure 28)
ASTKGPSVFPLAPSSKSTSEGTAALGCLVKDYFPEPVTVSWNSGALTSGVHTFPAVLQSSGLYSLSSVVTVPSSSLGTQTYICNVDHKPSNTKVDKTVEPKSCVECPPCPAPPVAGPSVFLFPPKPKDTLMISRTPEVTCVVVDVSHEDPEVQFNWYVDGVEVHNAKTKPREEQYNSTYRVVSVLTVLHQDWLNGKEYKCKVSNKGLPAPIEKTISKAKGQPREPQWTLPPSQEEMTKNQVSLTCLVKGFYPSDIAVEWESNGQPENNYNTTPPVLDSDGSFFLYSKLTVDKSRWQEGNVFSCSVMHEALHNHYTQKSLSLSPG

SEQ ID NO: 22 - protein, 328 aa, Artificial Sequence
  IgG-pI-Iso3  (Figure 28)
ASTKGPSVFPLAPSSKSTSESTAALGCLVKDYFPEPVTVSWNSGALTSGVHTFPAVLQSSGLYSLSSVVTVPSSNFGTQTYTCNVDHKPSNTKVDKTVEPKSCDTTHTCPPCPAPELLGGPSVFLFPPKPKDTLMISRTPEVTCVVVDVSHEDPEVQFNWYVDGVEVHNAKTKPREEQFNSTFRVVSVLTVVHQDWLNGKEYKCKVSNKALPAPIEKTISKTKGQPREPQWTLPPSQEEMTKNQVSLTCLVKGFYPSDIAVEWESSGQPENNYNTTPPMLDSDGSFFLYSKLTVDKSRWQEGNVFSCSVMHEALHNHYTQKSLSLSPG

SEQ ID NO: 23 - protein, 328 aa, Artificial Sequence
  IgG-pI-Iso3-SL  (Figure 28)
ASTKGPSVFPLAPSSKSTSESTAALGCLVKDYFPEPVTVSWNSGALTSGVHTFPAVLQSSGLYSLSSVVTVPSSSLGTQTYTCNVDHKPSNTKVDKTVEPKSCDTTHTCPPCPAPELLGGPSVFLFPPKPKDTLMISRTPEVTCVVVDVSHEDPEVQFNWYVDGVEVHNAKTKPREEQFNSTFRWSVLTVVHQDWLNGKEYKCKVSNKALPAPIEKTISKTKGQPREPQVYTLPPSQEEMTKNQVSLTCLVKGFYPSDIAVEWESSGQPENNYNTTPPMLDSDGSFFLYSKLTVDKSRWQEGNVFSCSVMHEALHNHYTQKSLSLSPG

SEQ ID NO: 24 - protein, 328 aa, Artificial Sequence
  IgG-pI-Iso3-charges-only  (Figure 28)
ASTKGPSVFPLAPSSKSTSEGTAALGCLVKDYFPEPVTVSWNSGALTSGVHTFPAVLQSSGLYSLSSVVTVPSSSLGTQTYICNVDHKPSNTKVDKTVEPKSCDTTHTCPPCPAPELLGGPSVFLFPPKPKDTLMISRTPEVTCVVVDVSHEDPEVQFNWYVDGVEVHNAKTKPREEQYNSTYRWSVLTVLHQDWLNGKEYKCKVSNKALPAPIEKTISKAKGQPREPQVYTLPPSQEEMTKNQVSLTCLVKGFYPSDIAVEWESNGQPENNYNTTPPVLDSDGSFFLYSKLTVDKSRWQEGNVFSCSVMHEALHNHYTQKSLSLSPG

SEQ ID NO: 25 - protein, 328 aa, Artificial Sequence
  IgG1-pI(7)  (Figure 28)
ASTKGPSVFPLAPSSESTSGGTAALGCLVKDYFPEPVTVSWNSGALTSGVHTFPAVLQSSGLYSLSSVVTVPSSSLGTQTYICNVNHEPSNTEVDKKVEPKSCDKTHTCPPCPAPELLGGPSVFLFPPKPKDTLMISRTPEVTCVVVDVSHEDPEVEFNWYVDGVEVHNAKTKPREEQYNSTYRWSVLTVLHQDWLNGKEYKCKVSNKALPAPIEKTISKAKGQPREPQVYTLPPSEEEMTKNQVSLTCLVKGFYPSDIAVEWESNGQPENNYETTPPVLDSDGSFFLYSKLTVDKSRWQQGNVFSCSVMHEALHNHYTQKSLSLSPG

SEQ ID NO: 26 - protein, 328 aa, Artificial Sequence
  lgG1-pl(11)  (Figure 28)
ASTKGPSVFPLAPSSESTSGGTAALGCLVKDYFPEPVTVSWNSGALTSGVHTFPAVLQSSGLYSLSSVVTVPSSSLGTQTYICNVNHEPSNTEVDKKVEPKSCDKTHTCPPCPAPELLGGPSVFLFPPKPKDTLMISRTPEVTCVVVDVSHEDPEVEFNWYVDGVEVHNAKTKPREEQYNSTYRWSVLTVLHQDWLNGKEYECEVSNEALPAPIEETISKAKGQPREPQVYTLPPSEEEMTKNQVSLTCLVKGFYPSDIAVEWESNGQPENNYETTPPVLDSDGSFFLYSKLTVDKSRWQQGNVFSCSVMHEALHNHYTQKSLSLSPG

SEQ ID NO: 27 - protein, 326 aa, Artificial Sequence
  lgG1/2-pl(7)  (Figure 28)
ASTKGPSVFPLAPSSESTSGGTAALGCLVKDYFPEPVTVSWNSGALTSGVHTFPAVLQSSGLYSLSSVVTVPSSSLGTQTYICNVNHEPSNTEVDKKVEPKSCDKTHTCPPCPAPPVAGPSVFLFPPKPKDTLMISRTPEVTCVVVDVSHEDPEVEFNWYVDGVEVHNAKTKPREEQFNSTFRWSVLTVVHQDWLNGKEYKCKVSNKGLPAPIEKTISKTKGQPREPQWTLPPSEEEMTKNQVSLTCLVKGFYPSDIAVEWESNGQPENNYETTPPMLDSDGSFFLYSKLTVDKSRWQQGNVFSCSVMHEALHNHYTQKSLSLSPG

SEQ ID NO: 28 - protein, 326 aa, Artificial Sequence
  lgG1/2-pl(11)  (Figure 28)
ASTKGPSVFPLAPSSESTSGGTAALGCLVKDYFPEPVTVSWNSGALTSGVHTFPAVLQSSGLYSLSSVVTVPSSSLGTQTYICNVNHEPSNTEVDKKVEPKSCDKTHTCPPCPAPPVAGPSVFLFPPKPKDTLMISRTPEVTCVVVDVSHEDPEVEFNWYVDGVEVHNAKTKPREEQFNSTFRWSVLTVVHQDWLNGKEYECEVSNEGLPAPIEETISKTKGQPREPQWTLPPSEEEMTKNQVSLTCLVKGFYPSDIAVEWESNGQPENNYETTPPMLDSDGSFFLYSKLTVDKSRWQQGNVFSCSVMHEALHNHYTQKSLSLSPG

SEQ ID NO: 29 - protein, 106 aa, Artificial Sequence
  CK-pI(4)  (Figure 28)
RTVAAPSVFIFPPSDEQLESGTASWCLLNNFYPREAEVQWKVDNALQSGNSQESVTEQDSEDSTYSLSSTLTLSKADYEKHKVYACEVTHQGLSSPVTESFNRGEC

SEQ ID NO: 30 - protein, 107 aa, Artificial Sequence
  CK-Iso(3)  (Figure 28)
QTVAAPSVFIFPPSDEQLQSGTASVVCLLNNFYPREAKVQWKVDNALQSGNSQESVTEQDSKDSTYSLSSTLTLSKADYEKHKVYACEVTHEGLSSPVTKSFNRGEC

SEQ ID NO: 31 - protein, 106 aa, Artificial Sequence
  CK-Iso(4)  (Figure 28)
QTVAAPSVFIFPPSDEQLQSGTASWCLLNNFYPREATVQWKVDNALQSGNSQESVTEQDSKDSTYSLSSTLTLSKADYEKHKVYACEVTHEGLSSPVTKSFNRGEC

SEQ ID NO: 32 - protein, 107 aa, Artificial Sequence
  CK-Iso(5)  (Figure 28)
QTVAAPSVFIFPPSDEELQSGTASVVCLLNNFYPREATVQWKVDNALQSGNSQESVTEQDSKDSTYSLSSTLTLSKADYEKHKVYACEVTHEGLSSPVTKSFNRGEC

SEQ ID NO: 33 - protein, 107 aa, Artificial Sequence
  CK-Iso(6)  (Figure 28)
QTVAAPSVFIFPPSDEELQSGTASVVCLLNDFYPREATVQWKVDNALQSGNSQESVTEQDSKDSTYSLSSTLTLSKADYEKHKVYACEVTHEGLSSPVTKSFNRGEC

SEQ ID NO: 34 - protein, 453 aa, Artificial Sequence
  Heavy Chain 1 of XENP1 0653  (Figure 39)
EVQLVESGGGLVQPGGSLRLSCAASGYTFTNYGMNWVRQAPGKGLEWVGWINTYTGEPTYAADFKRRFTFSLDTSKSTAYLQMNSLRAEDTAVYYCAKYPHYYGSSHWYFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 35 - protein, 452 aa, Artificial Sequence
  Heavy Chain 2 of XENP1 0653  (Figure 39)
EVQLVESGGGLVQPGGSLRLSCAASGYTFTNYGMNWVRQAPGKGLEWVGWINTYTGEPTYAADFKRRFTFSLDTSKSTAYLQMNSLRAEDTAVYYCAKYPHYYGSSHWYFDVWGQGTLVTVSSASTKGPSVFPLAPSSKSTSGGTAALGCLVKDYFPEPVTVSWNSGALESGVHTFPAVLQSSGLYSLSSVVTVPSSSLGTQTYICNVNHKPSDTEVDKKVEPKSCDKTHTCPPCPAPELLGGPSVFLFPPKPKDTLMISRTPEVTCVVVDVSHEDPEVQFNWYVDGVEVHNAKTKPREEQYNSTYRVVSVLTVLHQDWLNGKEYKCKVSNKALPAPIEKTISKAKGQPREPQVYTLPPSQEEMTKNQVSLTCLVKGFYPSDIAVEWESSGQPENNYNTTPPMLDSDGSFFLYSKLTVDKSRWQEGNVFSCSVMHEALHNHYTQKSLSLSPG

SEQ ID NO: 36 - protein, 214 aa, Artificial Sequence
  Light Chain of XENP1 0653  (Figure 39)
DIQMTQSPSSLSASVGDRVTITCSASQDISNYLNWYQQKPGKAPKVLIYFTSSLHSGVPSRFSGSGSGTDFTLTISSLQPEDFATYYCQQYSTVPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 37 - protein, 599 aa, Artificial Sequence
  Heavy Chain 1 of anti-HER2 x anti-CD16 mAb-Fv  (Figure 39)
EVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSREEMTKNQVHLTCLVKGFYPSDIAVEWESNGQPENNYKTTPPVLDSDGSFALYSKLTVDKSRWQQGNVFSCSVMHEALHNHYTQKSLSLSPGKSSDKTHTSPPSPGGGGSGGGGSGGGGSGGGGQVTLKESGPGILQPSQTLSLTCSFSGFSLRTSGMGVGWIRQPSGKGLEWLAHIWWDDDKRYNPALKSRLTISKDTSSNQVFLKIASVDTADTATYYCAQINPAWFAYWGQGTLVTVSA

SEQ ID NO: 38 - protein, 592 aa, Artificial Sequence
  Heavy Chain 2 of anti-HER2 x anti-CD16 mAb-Fv  (Figure 39)
EVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSASTKGPSVFPLAPSSKSTSGGTAALGCLVKDYFPEPVTVSWNSGALESGVHTFPAVLQSSGLYSLSSVVTVPSSSLGTQTYICNVNHKPSDTEVDKKVEPKSCDKTHTCPPCPAPELLGGPSVFLFPPKPKDTLMISRTPEVTCVVVDVSHEDPEVQFNWYVDGVEVHNAKTKPREEQYNSTYRVVSVLTVLHQDWLNGKEYKCKVSNKALPAPIEKTISKAKGQPREPQVTTLPPCQEEMTKNQVSLTCLVKGFYPSDIAVEWESSGQPENNYNTFPPMLDSDGSFFLYSKLTVDKSRWQEGNVFSCSVMHEALHNHYTQKSLSLSPGKSSDKTHTSPPSPGGGGSGGGGSGGGGSGGGGDIVLTQSPASLAVSLGQRATISCKASQSVDFDGDSFMNWYQQKPGQPPKLLIYTTSNLESGIPARFSASGSGTDFTLNIHPVEEEDTATYYCQQSNEDPYTFGGGTKLELK

SEQ ID NO: 39 - protein, 214 aa, Artificial Sequence
  Light Chain of anti-HER2 x anti-CD16 mAb-Fv  (Figure 39)
DIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 40 - protein, 599 aa, Artificial Sequence
  Heavy Chain 1 of anti-CD19 x anti-CD16 mAb-Fv  (Figure 39)
EVQLVESGGGLVKPGGSLKLSCAASGYTFTSYVMHWVRQAPGKGLEWIGYINPYNDGTKYNEKFQGRVTISSDKSISTAYMELSSLRSEDTAMYYCARGTYYYGTRVFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRWSVLTVLHQDWLNGKEYKCKVSNKALPAPIEKTISKAKGQPREPQVCTLPPSREEMTKNQVHLTCLVKGFYPSDIAVEWESNGQPENNYKTTPPVLDSDGSFALYSKLTVDKSRWQQGNVFSCSVMHEALHNHYTQKSLSLSPGKSSDKTHTSPPSPGGGGSGGGGSGGGGSGGGGQVTLKESGPGILQPSQTLSLTCSFSGFSLRTSGMGVGWIRQPSGKGLEWLAHIWWDDDKRYNPALKSRLTISKDTSSNQVFLKIASVDTADTATYYCAQINPAWFAYWGQGTLVTVSA

SEQ ID NO: 41 - protein, 591 aa, Artificial Sequence
  Heavy Chain 2 of anti-CD19 x anti-CD16 mAb-Fv  (Figure 39)
EVQLVESGGGLVKPGGSLKLSCAASGYTFTSYVMHWVRQAPGKGLEWIGYINPYNDGTKYNEKFQGRVTISSDKSISTAYMELSSLRSEDTAMYYCARGTYYYGTRVFDYWGQGTLVTVSSASTKGPSVFPLAPSSKSTSGGTAALGCLVKDYFPEPVTVSWNSGALESGVHTFPAVLQSSGLYSLSSVVTVPSSSLGTQTYICNVNHKPSDTEVDKKVEPKSCDKTHTCPPCPAPELLGGPSVFLFPPKPKDTLMISRTPEVTCWVDVSHEDPEVQFNWYVDGVEVHNAKTKPREEQYNSTYRWSVLTVLHQDWLNGKEYKCKVSNKALPAPIEKTISKAKGQPREPQVTTLPPCQEEMTKNQVSLTCLVKGFYPSDIAVEWESSGQPENNYNTFPPMLDSDGSFFLYSKLTVDKSRWQEGNVFSCSVMHEALHNHYTQKSLSLSPGKSSDKTHTSPPSPGGGGSGGGGSGGGGSGGGGDIVLTQSPASLAVSLGQRATISCKASQSVDFDGDSFMNWYQQKPGQPPKLLIYTTSNLESGIPARFSASGSGTDFTLNIHPVEEEDTATYYCQQSNEDPYTFGGGTKLELK

SEQ ID NO: 42 - protein, 218 aa, Artificial Sequence
  Light Chain of anti-CD19 x anti-CD16 mAb-Fv  (Figure 39)
DIVMTQSPATLSLSPGERATLSCRSSKSLQNVNGNTYLYWFQQKPGQSPQLLIYRMSNLNSGVPDRFSGSGSGTEFTLTISSLEPEDFAWYCMQHLEYPITFGAGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 43 - protein, 599 aa, Artificial Sequence [sequence omitted]

SEQ ID NO: 44 - protein, 589 aa, Artificial Sequence
  Heavy Chain 2 of anti-CD19 x anti-CD32b mAb-Fv  (Figure 39)
EVQLVESGGGLVKPGGSLKLSCAASGYTFTSYVMHWVRQAPGKGLEWIGYINPYNDGTKYNEKFQGRVTISSDKSISTAYMELSSLRSEDTAMYYCARGTYYYGTRVFDYWGQGTLVTVSSASTKGPSVFPLAPSSKSTSGGTAALGCLVKDYFPEPVTVSWNSGALESGVHTFPAVLQSSGLYSLSSVVTVPSSSLGTQTYICNVNHKPSDTEVDKKVEPKSCDKTHTCPPCPAPELLGGPSVFLFPPKPKDTLMISRTPEVTCVVVDVSHEDPEVQFNWYVDGVEVHNAKTKPREEQYNSTYRVVSVLTVLHQDWLNGKEYKCKVSNKALPAPIEKTISKAKGQPREPQVTTLPPCQEEMTKNQVSLTCLVKGFYPSDIAVEWESSGQPENNYNTFPPMLDSDGSFFLYSKLTVDKSRWQEGNVFSCSVMHEALHNHYTQKSLSLSPGKSSDKTHTSPPSPGGGGSGGGGSGGGGSGGGGDVVLTQSPATLSVTPGDSVSLSCRASQGISNNLHWYQQKSHESPRLLIKYASQSISGIPSRFSGSGSGTDFTLSINSVETEDFGMYFCQQSDSWPHTFGGGTKLEIK

SEQ ID NO: 45 - protein, 218 aa, Artificial Sequence; identical to SEQ ID NO: 42
  Light Chain of anti-CD19 x anti-CD32b mAb-Fv  (Figure 39)

SEQ ID NO: 46 - protein, 592 aa, Artificial Sequence [sequence omitted]

SEQ ID NO: 47 - protein, 581 aa, Artificial Sequence
  Heavy Chain 2 of anti-CD40 x anti-CD32b mAb-Fv  (Figure 39)
QVKLEESGPGLVAPSQSLSITCTVSGFSLSRYSVYWVRQPPGKGLEWLGMMWGGGSTDYNSALKSRLSISKDTSKSQVFLKMNSLQTDDTAMYYCVRTDGDYWGQGTSVTVSSASTKGPSVFPLAPSSKSTSGGTAALGCLVKDYFPEPVTVSWNSGALESGVHTFPAVLQSSGLYSLSSVVTVPSSSLGTQTYICNVNHKPSDTEVDKKVEPKSCDKTHTCPPCPAPELLGGPSVFLFPPKPKDTLMISRTPEVTCVVVDVSHEDPEVQFNWYVDGVEVHNAKTKPREEQYNSTYRVVSVLTVLHQDWLNGKEYKCKVSNKALPAPIEKTISKAKGQPREPQVTTLPPCQEEMTKNQVSLTCLVKGFYPSDIAVEWESSGQPENNYNTFPPMLDSDGSFFLYSKLTVDKSRWQEGNVFSCSVMHEALHNHYTQKSLSLSPGKSSDKTHTSPPSPGGGGSGGGGSGGGGSGGGGDVVLTQSPATLSVTPGDSVSLSCRASQGISNNLHWYQQKSHESPRLLIKYASQSISGIPSRFSGSGSGTDFTLSINSVETEDFGMYFCQQSDSWPHTFGGGTKLEIK

SEQ ID NO: 48 - protein, 219 aa, Artificial Sequence
  Light Chain of anti-CD40 x anti-CD32b mAb-Fv  (Figure 39)
ELQLTQSPLSLPVSLGDQASISCRSSQSLVNSNGNTYLHWYLQKPGQSPKLLIYKVSNRFSGVPDRFSGSGSGTDFTLKISRVEAEDLGVYFCSQSTHVPWTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 49 - protein, 600 aa, Artificial Sequence
  Heavy Chain 1 of anti-HER2 x anti-CD3 mAb-Fv  (Figure 39)
EVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSREEMTKNQVHLTCLVKGFYPSDIAVEWESNGQPENNYKTTPPVLDSDGSFALYSKLTVDKSRWQQGNVFSCSVMHEALHNHYTQKSLSLSPGKSSDKTHTSPPSPGGGGSGGGGSGGGGSGGGGQVQLVQSGAEVKKPGASVKVSCKASGYTFTRYTMHWVRQAPGQGLEWMGYINPSRGYTNYNQKFQGRVTMTTDKSTSTAYMELSSLRSEDTAVYYCARYYDDHYSLDYWGQGTTVTVSS

SEQ ID NO: 50 - protein, 329 aa, Artificial Sequence
  lgG1-434S  (Figure 20)
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRWSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHSHYTQKSLSLSPGK

SEQ ID NO: 51 - protein, 325 aa, Artificial Sequence
  lgG2-434S  (Figure 20)
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRWSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHSHYTQKSLSLSPGK

SEQ ID NO: 52 - protein, 329 aa, Artificial Sequence
  lgG1-CH1-pi(6)-434S  (Figure 4)
AETKGPSVFPLAPSSESTSGGTAALGCLVKDYFPEPVTVSWNSGALESGVHTFPAVLQSSGLYSLSSVVTVPSSSLGTQTYICNVNHEPSDTEVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQWTLPPSREEMTKNQVSLTCLVKGFYPSDIAVEWESNGQPENNYKTTPPVLDSDGSFFLYSKLTVDKSRWQQGNVFSCSVMHEALHSHYTQKSLSLSPGK

SEQ ID NO: 53 - protein, 329 aa, Artificial Sequence
  lgG1-CH1-pi(6)-428L/434S  (Figure 4)
AETKGPSVFPLAPSSESTSGGTAALGCLVKDYFPEPVTVSWNSGALESGVHTFPAVLQSSGLYSLSSVVTVPSSSLGTQTYICNVNHEPSDTEVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQWTLPPSREEMTKNQVSLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 54 - protein, 106 aa, Artificial Sequence; identical to SEQ ID NO: 17
  CK-pl(3)  (Figure 20)

SEQ ID NO: 55 - protein, 328 aa, Artificial Sequence
  lgG1-pi(6)-Neutral-to-DE  (Figure 20)
AETKGPSVFPLAPSSKSTSGGTAALGCLVKDYFPEPVTVSWNSGALESGVHTFPAVLQSSGLYSLSSVVTVPSSSLGTQTYICNVNHKPSDTKVDKKVEPKSCDKTHTCPPCPAPELLGGPSVFLFPPKPKDTLMISRTPEVTCVWDVSHEDPEVKFNWYVDGVEVHNAKTKPREEQYNSTYRVVSVLTVLHQDWLNGKEYKCKVSNKALPAPIEKTISKAKGQPREPQWTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 56 - protein, 328 aa, Artificial Sequence
  lgG1-pi(6)-KR-to-Neutral  (Figure 20)
ASTKGPSVFPLAPSSQSTSGGTAALGCLVKDYFPEPVTVSWNSGALTSGVHTFPAVLQSSGLYSLSSVVTVPSSSLGTQTYICNVNHQPSNTQVDKKVEPKSCDKTHTCPPCPAPELLGGPSVFLFPPKPKDTLMISRTPEVTCVWDVSHEDPEVKFNWYVDGVEVHNAKTKPREEQYNSTYRVVSVLTVLHQDWLNGKEYKCKVSNKALPAPIEKTISKAKGQPREPQWTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 57 - protein, 329 aa, Artificial Sequence
  lgG1-pi(6)-KR-to-DE  (Figure 20)
ASTKGPSVFPLAPSSESTSGGTAALGCLVKDYFPEPVTVSWNSGALTSGVHTFPAVLQSSGLYSLSSVVTVPSSSLGTQTYICNVNHEPSNTEVDKKVEPKSCDKTHTCPPCPAPELLGGPSVFLFPPKPKDTLMISRTPEVTCVVVDVSHEDPEVKFNWYVDGVEVHNAKTKPREEQYNSTYRWSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 58 - protein, 106 aa, Artificial Sequence
  CK-N152D S156E S202E  (Figure 20)
RTVAAPSVFIFPPSDEQLKSGTASWCLLNNFYPREAKVQWKVDDALQEGNSQESVTEQDSKDSTYSLSSTLTLSKADYEKHKVYACEVTHQGLESPVTKSFNRGEC

SEQ ID NO: 59 - protein, 107 aa, Artificial Sequence
  CK-K126Q K145Q K169Q  (Figure 20)
RTVAAPSVFIFPPSDEQLQSGTASVVCLLNNFYPREAQVQWKVDNALQSGNSQESVTEQDSQDSTYSLSSTLTLSKADYEKHKVYACEVTHQGLSSPVTKSFNRGEC

SEQ ID NO: 60 - protein, 106 aa, Artificial Sequence; identical to SEQ ID NO: 17
  CK-K126E K145E K169E  (Figure 20)

SEQ ID NO: 61 - protein, 325 aa, Artificial Sequence
  IgG-pi-Iso2-434S  (Figure 28)
ASTKGPSVFPLAPSSKSTSESTAALGCLVKDYFPEPVTVSWNSGALTSGVHTFPAVLQSSGLYSLSSVVTVPSSSLGTQTYTCNVDHKPSNTKVDKTVEPKSCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSQEEMTKNQVSLTCLVKGFYPSDIAVEWESSGQPENNYNTTPPMLDSDGSFFLYSKLTVDKSRWQEGNVFSCSVMHEALHSHYTQKSLSLSPG

SEQ ID NO: 62 - protein, 327 aa, Artificial Sequence
  IgG-pI-Iso3-434S  (Figure 28)
ASTKGPSVFPLAPSSKSTSESTAALGCLVKDYFPEPVTVSWNSGALTSGVHTFPAVLQSSGLYSLSSVVTVPSSNFGTQTYTCNVDHKPSNTKVDKTVEPKSCDTTHTCPPCPAPELLGGPSVFLFPPKPKDTLMISRTPEVTCVVVDVSHEDPEVQFNWYVDGVEVHNAKTKPREEQFNSTFRWSVLTWHQDWLNGKEYKCKVSNKALPAPIEKTISKTKGQPREPQVYTLPPSQEEMTKNQVSLTCLVKGFYPSDIAVEWESSGQPENNYNTTPPMLDSDGSFFLYSKLTVDKSRWQEGNVFSCSVMHEALHSHYTQKSLSLSPG

SEQ ID NO: 63 - protein, 327 aa, Artificial Sequence
  IgG-pI-Iso3-SL-434S  (Figure 28)
ASTKGPSVFPLAPSSKSTSESTAALGCLVKDYFPEPVTVSWNSGALTSGVHTFPAVLQSSGLYSLSSVVTVPSSSLGTQTYTCNVDHKPSNTKVDKTVEPKSCDTTHTCPPCPAPELLGGPSVFLFPPKPKDTLMISRTPEVTCVVVDVSHEDPEVQFNWYVDGVEVHNAKTKPREEQFNSTFRWSVLTWHQDWLNGKEYKCKVSNKALPAPIEKTISKTKGQPREPQVYTLPPSQEEMTKNQVSLTCLVKGFYPSDIAVEWESSGQPENNYNTTPPMLDSDGSFFLYSKLTVDKSRWQEGNVFSCSVMHEALHSHYTQKSLSLSPG

SEQ ID NO: 64 - protein, 328 aa, Artificial Sequence
  IgG-pI-Iso3-SL  (Figure 28)
ASTKGPSVFPLAPSSKSTSESTAALGCLVKDYFPEPVTVSWNSGALTSGVHTFPAVLQSSGLYSLSSVVTVPSSSLGTQTYTCNVDHKPSNTKVDKTVEPKSCDTTHTCPPCPAPELLGGPSVFLFPPKPKDTLMISRTPEVTCVVVDVSHEDPEVQFNWYVDGVEVHNAKTKPREEQFNSTFRWSVLTVVHQDWLNGKEYKCKVSNKALPAPIEKTISKTKGQPREPQVYTLPPSQEEMTKNQVSLTCLVKGFYPSDIAVEWESSGQPENNYNTTPPMLDSDGSFFLYSKLTVDKSRWQEGNVFSCSVLHEALHSHYTQKSLSLSPG

SEQ ID NO: 65 - protein, 325 aa, Artificial Sequence; identical to SEQ ID NO: 61
  IgG-PI-Iso2-434S  (Figure 28)

SEQ ID NO: 66 - protein, 328 aa, Artificial Sequence
  IgG-pI-Iso3-charges-only-434S  (Figure 28)
ASTKGPSVFPLAPSSKSTSEGTAALGCLVKDYFPEPVTVSWNSGALTSGVHTFPAVLQSSGLYSLSSVVTVPSSSLGTQTYICNVDHKPSNTKVDKTVEPKSCDTTHTCPPCPAPELLGGPSVFLFPPKPKDTLMISRTPEVTCVVVDVSHEDPEVQFNWYVDGVEVHNAKTKPREEQYNSTYRWSVLTVLHQDWLNGKEYKCKVSNKALPAPIEKTISKAKGQPREPQVYTLPPSQEEMTKNQVSLTCLVKGFYPSDIAVEWESNGQPENNYNTTPPVLDSDGSFFLYSKLTVDKSRWQEGNVFSCSVMHEALHSHYTQKSLSLSPG

SEQ ID NO: 67 - protein, 324 aa, Artificial Sequence
  IgG-pI-Iso2-charges-only-434S  (Figure 28)
ASTKGPSVFPLAPSSKSTSEGTAALGCLVKDYFPEPVTVSWNSGALTSGVHTFPAVLQSSGLYSLSSVVTVPSSSLGTQTYICNVDHKPSNTKVDKTVEPKSCVECPPCPAPPVAGPSVFLFPPKPKDTLMISRTPEVTCVVVDVSHEDPEVQFNWYVDGVEVHNAKTKPREEQYNSTYRVVSVLTVLHQDWLNGKEYKCKVSNKGLPAPIEKTISKAKGQPREPQWTLPPSQEEMTKNQVSLTCLVKGFYPSDIAVEWESNGQPENNYNTTPPVLDSDGSFFLYSKLTVDKSRWQEGNVFSCSVMHEALHSHYTQKSLSLSPG

SEQ ID NO: 68 - protein, 328 aa, Artificial Sequence
  lgG1-pi(7)-434S  (Figure 28)
ASTKGPSVFPLAPSSESTSGGTAALGCLVKDYFPEPVTVSWNSGALTSGVHTFPAVLQSSGLYSLSSVVTVPSSSLGTQTYICNVNHEPSNTEVDKKVEPKSCDKTHTCPPCPAPELLGGPSVFLFPPKPKDTLMISRTPEVTCVVVDVSHEDPEVEFNWYVDGVEVHNAKTKPREEQYNSTYRWSVLTVLHQDWLNGKEYKCKVSNKALPAPIEKTISKAKGQPREPQVYTLPPSEEEMTKNQVSLTCLVKGFYPSDIAVEWESNGQPENNYETTPPVLDSDGSFFLYSKLTVDKSRWQQGNVFSCSVMHEALHSHYTQKSLSLSPG

SEQ ID NO: 69 - protein, 326 aa, Artificial Sequence
  lgG1/2_pi(7)-434S  (Figure 28)
ASTKGPSVFPLAPSSESTSGGTAALGCLVKDYFPEPVTVSWNSGALTSGVHTFPAVLQSSGLYSLSSVVTVPSSSLGTQTYICNVNHEPSNTEVDKKVEPKSCDKTHTCPPCPAPPVAGPSVFLFPPKPKDTLMISRTPEVTCVVVDVSHEDPEVEFNWYVDGVEVHNAKTKPREEQFNSTFRWSVLTVVHQDWLNGKEYKCKVSNKGLPAPIEKTISKTKGQPREPQWTLPPSEEEMTKNQVSLTCLVKGFYPSDIAVEWESNGQPENNYETTPPMLDSDGSFFLYSKLTVDKSRWQQGNVFSCSVMHEALHSHYTQKSLSLSPG

SEQ ID NO: 70 - protein, 587 aa, Artificial Sequence
  Heavy Chain 2 of anti-HER2 x anti-CD3 mAb-Fv  (Figure 39)
EVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSASTKGPSVFPLAPSSKSTSGGTAALGCLVKDYFPEPVTVSWNSGALESGVHTFPAVLQSSGLYSLSSVVTVPSSSLGTQTYICNVNHKPSDTEVDKKVEPKSCDKTHTCPPCPAPELLGGPSVFLFPPKPKDTLMISRTPEVTCVVVDVSHEDPEVQFNWYVDGVEVHNAKTKPREEQYNSTYRVVSVLTVLHQDWLNGKEYKCKVSNKALPAPIEKTISKAKGQPREPQVTTLPPCQEEMTKNQVSLTCLVKGFYPSDIAVEWESSGQPENNYNTFPPMLDSDGSFFLYSKLTVDKSRWQEGNVFSCSVMHEALHNHYTQKSLSLSPGKSSDKTHTSPPSPGGGGSGGGGSGGGGSGGGGQIVLTQSPATLSLSPGERATLSCRASSSVSYMNWYQQKPGQSPRRLIYDTSKLASGVPARFRGSGSGTDYTLTISSLEPEDFAVYYCQQWSSNPFTFGSGTKLEIK

SEQ ID NO: 71 - protein, 214 aa, Artificial Sequence; identical to SEQ ID NO: 39
  Light Chain of anti-HER2 x anti-CD3 mAb-Fv  (Figure 39)

SEQ ID NO: 72 - protein, 474 aa, Artificial Sequence
  Heavy Chain 1 of anti-HER2 x anti-CD3 scFv-Fc  (Figure 39)
QVQLVQSGAEVKKPGASVKVSCKASGYTFTRYTMHWVRQAPGQGLEWMGYINPSRGYTNYNQKFQGRVTMTTDKSTSTAYMELSSLRSEDTAVYYCARYYDDHYSLDYWGQGTTVTVSSGGGGSGGGGSGGGGSQIVLTQSPATLSLSPGERATLSCRASSSVSYMNWYQQKPGQSPRRLIYDTSKLASGVPARFRGSGSGTDYTLTISSLEPEDFAVYYCQQWSSNPFTFGSGTKLEIKRTEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSREEMTKNQVHLTCLVKGFYPSDIAVEWESNGQPENNYKTTPPVLDSDGSFALYSKLTVDKSRWQQGNVFSCSVMHEALHNHYTQKSLSLSPGK

SEQ ID NO: 73 - protein, 475 aa, Artificial Sequence
  Heavy Chain 2 of anti-HER2 x anti-CD3 scFv-Fc  (Figure 39)
EVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSGGGGSGGGGSGGGGSDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKRTEPKSSDKTHTCPPCPAPELLGGPSVFLFPPKPKDTLMISRTPEVTCVWDVSHEDPEVQFNWYVDGVEVHNAKTKPREEQYNSTYRVVSVLTVLHQDWLNGKEYKCKVSNKALPAPIEKTISKAKGQPREPQVTTLPPCQEEMTKNQVSLTCLVKGFYPSDIAVEWESSGQPENNYNTFPPMLDSDGSFFLYSKLTVDKSRWQEGNVFSCSVMHEALHNHYTQKSLSLSPGK

SEQ ID NO: 74 - protein, 329 aa, Artificial Sequence
  ISO(-)  (Figure 53)
ASTKGPSVFPLAPSSKSTSGGTAALGCLVKDYFPEPVTVSWNSGALTSGVHTFPAVLQSSGLYSLSSVVTVPSSSLGTQTYTCNVDHKPSNTKVDKKVEPKSCDKTHTCPPCPAPELLGGPSVFLFPPKPKDTLMISRTPEVTCVVVDVSHEDPEVQFNWYVDGVEVHNAKTKPREEQYNSTYRVVSVLTVLHQDWLNGKEYKCKVSNKALPAPIEKTISKAKGQPREPQVYTLPPSQEEMTKNQVSLTCLVKGFYPSDIAVEWESSGQPENNYNTIPPMLDSDGSFFLYSKLTVDKSRWQEGNVFSCSVMHEALHNHYTQKSLSLSPG

SEQ ID NO: 75 - protein, 330 aa, Artificial Sequence
  ISO(+)  (Figure 53)
ASTKGPSVFPLAPSSKSTSGGTAALGCLVKDYFPEPVTVSWNSGALTSGVHTFPAVLQSSGLYSLSSVVTVPSSSLGTKTYTCNVNHKPSNTKVDKKVEPKSCDKTHTCPPCPAPELLGGPSVFLFPPKPKDTLMISRTPEVTCVVVDVSHEDPEVKFKWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTIPPVLDSDGSFFLYSKLTVDKSRWQQGNVFSCSVMHEALHNHYTQKSLSLSPGK

SEQ ID NO: 76 - protein, 330 aa, Artificial Sequence
  ISO(+RR)  (Figure 53)
ASTKGPSVFPLAPSSKSTSGGTAALGCLVKDYFPEPVTVSWNSGALTSGVHTFPAVLQSSGLYSLSSVVTVPSSSLGTKTYTCNVNHKPSNTKVDKKVERKSCDKTHTCPRCPAPELLGGPSVFLFPPKPKDTLMISRTPEVTCVVVDVSHEDPEVKFKWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTIPPVLDSDGSFFLYSKLTVDKSRWQQGNVFSCSVMHEALHNHYTQKSLSLSPGK

SEQ ID NO: 77 - protein, 452 aa, Artificial Sequence
  Anti-VEGF ISO(-) Heavy Chain  (Figure 53)
EVQLVESGGGLVQPGGSLRLSCAASGYTFTNYGMNWVRQAPGKGLEWVGWINTYTGEPTYAADFKRRFTFSLDTSKSTAYLQMNSLRAEDTAVYYCAKYPHYYGSSHWYFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYTCNVDHKPSNTKVDKKVEPKSCDKTHTCPPCPAPELLGGPSVFLFPPKPKDTLMISRTPEVTCVVVDVSHEDPEVQFNWYVDGVEVHNAKTKPREEQYNSTYRVVSVLTVLHQDWLNGKEYKCKVSNKALPAPIEKTISKAKGQPREPQVYTLPPSQEEMTKNQVSLTCLVKGFYPSDIAVEWESSGQPENNYNTIPPMLDSDGSFFLYSKLTVDKSRWQEGNVFSCSVMHEALHNHYTQKSLSLSPG

SEQ ID NO: 78 - protein, 453 aa, Artificial Sequence
  Anti-VEGF ISO(+) Heavy Chain  (Figure 53)
EVQLVESGGGLVQPGGSLRLSCAASGYTFTNYGMNWVRQAPGKGLEWVGWINTYTGEPTYAADFKRRFTFSLDTSKSTAYLQMNSLRAEDTAVYYCAKYPHYYGSSHWYFDVWGQGTLVTVSSASTKGPSVFPLAPSSKSTSGGTAALGCLVKDYFPEPVTVSWNSGALTSGVHTFPAVLQSSGLYSLSSVVTVPSSSLGTKTYTCNVNHKPSNTKVDKKVEPKSCDKTHTCPPCPAPELLGGPSVFLFPPKPKDTLMISRTPEVTCVVVDVSHEDPEVKFKWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTIPPVLDSDGSFFLYSKLTVDKSRWQQGNVFSCSVMHEALHNHYTQKSLSLSPGK

SEQ ID NO: 79 - protein, 453 aa, Artificial Sequence
  Anti-VEGF ISO(+RR) Heavy Chain  (Figure 53)
EVQLVESGGGLVQPGGSLRLSCAASGYTFTNYGMNWVRQAPGKGLEWVGWINTYTGEPTYAADFKRRFTFSLDTSKSTAYLQMNSLRAEDTAVYYCAKYPHYYGSSHWYFDVWGQGTLVTVSSASTKGPSVFPLAPSSKSTSGGTAALGCLVKDYFPEPVTVSWNSGALTSGVHTFPAVLQSSGLYSLSSVVTVPSSSLGTKTYTCNVNHKPSNTKVDKKVERKSCDKTHTCPRCPAPELLGGPSVFLFPPKPKDTLMISRTPEVTCVVVDVSHEDPEVKFKWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTIPPVLDSDGSFFLYSKLTVDKSRWQQGNVFSCSVMHEALHNHYTQKSLSLSPGK

SEQ ID NO: 80 - protein, 452 aa, Artificial Sequence
  Heavy Chain 1 of XENP10783 Anti-VEGF ISO(-) x lgGl(WT)  (Figure 54)
EVQLVESGGGLVQPGGSLRLSCAASGYTFTNYGMNWVRQAPGKGLEWVGWINTYTGEPTYAADFKRRFTFSLDTSKSTAYLQMNSLRAEDTAVYYCAKYPHYYGSSHWYFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYTCNVDHKPSNTKVDKKVEPKSCDKTHTCPPCPAPELLGGPSVFLFPPKPKDTLMISRTPEVTCVVVDVSHEDPEVQFNWYVDGVEVHNAKTKPREEQYNSTYRVVSVLTVLHQDWLNGKEYKCKVSNKALPAPIEKTISKAKGQPREPQVYTLPPSQEEMTKNQVSLTCLVKGFYPSDIAVEWESSGQPENNYNTTPPMLDSDGSFFLYSKLTVDKSRWQEGNVFSCSVMHEALHNHYTQKSLSLSPG

SEQ ID NO: 81 - protein, 453 aa, Artificial Sequence; identical to SEQ ID NO: 34
  Heavy Chain 2 of XENP10783 Anti-VEGF ISO(-) x lgGl(WT)  (Figure 54)

SEQ ID NO: 82 - protein, 214 aa, Artificial Sequence; identical to SEQ ID NO: 36
  Light Chain of XENP10783 Anti-VEGF ISO(-) x lgGl(WT)  (Figure 54)

SEQ ID NO: 83 - protein, 453 aa, Artificial Sequence; identical to SEQ ID NO: 79
  Heavy Chain 1 of XENP10784 Anti-VEGF ISO(+RR) x lgGl(WT)  (Figure 55)

SEQ ID NO: 84 - protein, 453 aa, Artificial Sequence
  Heavy Chain 2 of XENP10784 Anti-VEGF ISO(+RR) x lgGl(WT)  (Figure 55)
EVQLVESGGGLVQPGGSLRLSCAASGYTFTNYGMNWVRQAPGKGLEWVGWINTYTGEPTYAADFKRRFTFSLDTSKSTAYLQMNSLRAEDTAVYYCAKYPHYYGSSHWYFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTIPPVLDSDGSFFLYSKLTVDKSRWQQGNVFSCSVMHEALHNHYTQKSLSLSPGK

SEQ ID NO: 85 - protein, 214 aa, Artificial Sequence; identical to SEQ ID NO: 36
  Light Chain of XENP10784 Anti-VEGF ISO(+RR) x lgGl(WT)  (Figure 55)

SEQ ID NO: 86 - protein, 452 aa, Artificial Sequence; identical to SEQ ID NO: 80
  Heavy Chain 1 of XENP10896 Anti-VEGF ISO(-) x ISO(+RR)  (Figure 56)

SEQ ID NO: 87 - protein, 453 aa, Artificial Sequence
  Heavy Chain 2 of XENP10896 Anti-VEGF ISO(-) x ISO(+RR)  (Figure 56)
EVQLVESGGGLVQPGGSLRLSCAASGYTFTNYGMNWVRQAPGKGLEWVGWINTYTGEPTYAADFKRRFTFSLDTSKSTAYLQMNSLRAEDTAVYYCAKYPHYYGSSHWYFDVWGQGTLVTVSSASTKGPSVFPLAPSSKSTSGGTAALGCLVKDYFPEPVTVSWNSGALTSGVHTFPAVLQSSGLYSLSSVVTVPSSSLGTKTYTCNVNHKPSNTKVDKKVERKSCDKTHTCPRCPAPELLGGPSVFLFPPKPKDTLMISRTPEVTCVVVDVSHEDPEVKFKWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 88 - protein, 214 aa, Artificial Sequence; identical to SEQ ID NO: 36
  Light Chain of XENP10896 Anti-VEGF ISO(-) x ISO(+RR)  (Figure 56)

SEQ ID NO: 89 - protein, 452 aa, Artificial Sequence; identical to SEQ ID NO: 80
  Heavy Chain 1 of XENP10901 Anti-VEGF ISO(-) x ISO(+)  (Figure 57)

SEQ ID NO: 90 - protein, 453 aa, Artificial Sequence
  Heavy Chain 2 of XENP10901 Anti-VEGF ISO(-) x ISO(+)  (Figure 57)
EVQLVESGGGLVQPGGSLRLSCAASGYTFTNYGMNWVRQAPGKGLEWVGWINTYTGEPTYAADFKRRFTFSLDTSKSTAYLQMNSLRAEDTAVYYCAKYPHYYGSSHWYFDVWGQGTLVTVSSASTKGPSVFPLAPSSKSTSGGTAALGCLVKDYFPEPVTVSWNSGALTSGVHTFPAVLQSSGLYSLSSVVTVPSSSLGTKTYTCNVNHKPSNTKVDKKVEPKSCDKTHTCPPCPAPELLGGPSVFLFPPKPKDTLMISRTPEVTCVVVDVSHEDPEVKFKWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 91 - protein, 214 aa, Artificial Sequence; identical to SEQ ID NO: 36
  Light Chain of XENP10901 Anti-VEGF ISO(-) x ISO(+)  (Figure 57)

SEQ ID NO: 92 - protein, 125 aa, Artificial Sequence
  Humanized Anti-CD3 VH with Kabat CDRs underlined  (Figure 65)
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSS

SEQ ID NO: 93 - protein, 109 aa, Artificial Sequence
  Humanized Anti-CD3 VL with Kabat CDRs underlined  (Figure 65)
QAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVL

SEQ ID NO: 94 - protein, 121 aa, Artificial Sequence
  Humanized Anti-CD19 VH with Kabat CDRs underlined  (Figure 65)
EVQLVESGGGLVKPGGSLKLSCAASGYTFTSYVMHWVRQAPGKGLEWIGYINPYNDGTKYNEKFQGRVTISSDKSISTAYMELSSLRSEDTAMYYCARGTYYYGTRVFDYWGQGTLVTVSS

SEQ ID NO: 95 - protein, 112 aa, Artificial Sequence
  Humanized Anti-CD19 VL with Kabat CDRs underlined  (Figure 65)
DIVMTQSPATLSLSPGERATLSCRSSKSLQNVNGNTYLYWFQQKPGQSPQLLIYRMSNLNSGVPDRFSGSGSGTEFTLTISSLEPEDFAVYYCMQHLEYPITFGAGTKLEIK

SEQ ID NO: 96 - protein, 118 aa, Artificial Sequence
  Anti-CD32b VH with Kabat CDRs underlined  (Figure 65)
EVQLVESGGGLVSPGGSLKLSCVASGFAFSSYDMSWVRQTPEKRLEWVAKINSAGGRTNYPDTVKGRFTISRDNAENTLYLQMSSLKSEDTAMYYCAGHSYDYPFTYWGQGTLVTVSA

SEQ ID NO: 97 - protein, 107 aa, Artificial Sequence
  Anti-CD32b VL with Kabat CDRs underlined  (Figure 65)
DVVLTQSPATLSVTPGDSVSLSCRASQGISNNLHWYQQKSHESPRLLIKYASQSISGIPSRFSGSGSGTDFTLSINSVETEDFGMYFCQQSDSWPHTFGGGTKLEIK

SEQ ID NO: 98 - protein, 120 aa, Artificial Sequence
  Anti-CD32b VH with Kabat CDRs underlined  (Figure 65)
EVKVVESGGGLVQPGGSLKLSCAASGFTFSAYSMSWVRQTPEKRLEWVAYITNGGGRTYYPDTVEGRFTISRDNAKNTLYLQMSSLKSEDTAMYYCARHDYYVNYAMDYWGHGTSVTVSS

SEQ ID NO: 99 - protein, 107 aa, Artificial Sequence
  Anti-CD32b VL with Kabat CDRs underlined  (Figure 65)
DIVLIQSPATLSVTPGDSVSLSCRASHTISDNLHWYQQKSHESPRLLIKYASQSISGIPSRFSGSGSGTDFTLSINSVETEDFGMYFCQQSDSWPHTFGAGTKLELK

SEQ ID NO: 100 - protein, 112 aa, Artificial Sequence
  Anti-CD40 VH with Kabat CDRs underlined  (Figure 65)
DIQLQQSGPGLVKPSQSLSLTCSVTGYSITINYNWNWIRQFPGNKLEWMGYIRYDGTSEYTPSLKNRVSITRDTSMNQFFLRLTSVTPEDTATYYCARLDYWGQGTSVTVSS

SEQ ID NO: 101 - protein, 112 aa, Artificial Sequence
  Anti-CD40 VL with Kabat CDRs underlined  (Figure 65)
DAVMTQNPLSLPVSLGDEASISCRSSQSLENSNGNTFLNWFFQKPGQSPQLLIYRVSNRFSGVPDRFSGSGSGTDFTLKISRVEAEDLGVYFCLQVTHVPYTFGGGTILEIK

SEQ ID NO: 102 - protein, 113 aa, Artificial Sequence
  Anti-CD40 VH with Kabat CDRs underlined  (Figure 65)
QVKLEESGPGLVAPSQSLSITCTVSGFSLSRYSVYWVRQPPGKGLEWLGMMWGGGSTDYNSALKSRLSISKDTSKSQVFLKMNSLQTDDTAMYYCVRTDGDYWGQGTSVTVSS

SEQ ID NO: 103 - protein, 112 aa, Artificial Sequence
  Anti-CD40 VL with Kabat CDRs underlined  (Figure 65)
ELQLTQSPLSLPVSLGDQASISCRSSQSLVNSNGNTYLHWYLQKPGQSPKLLIYKVSNRFSGVPDRFSGSGSGTDFTLKISRVEAEDLGVYFCSQSTHVPWTFGGGTKLEIK

SEQ ID NO: 104 - protein, 589 aa, Artificial Sequence
  Heavy Chain 1 of anti-CD19 x anti-CD3 mAb-Fv [HC ISO(-) (VH)] (Figure 66)
EVQLVESGGGLVKPGGSLKLSCAASGYTFTSYVMHWVRQAPGKGLEWIGYINPYNDGTKYNEKFQGRVTISSDKSISTAYMELSSLRSEDTAMYYCARGTYYYGTRVFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYTCNVDHKPSNTKVDKKVEPKSCDKTHTCPPCPAPELLGGPSVFLFPPKPKDTLMISRTPEVTCVVVDVSHEDPEVQFNWYVDGVEVHNAKTKPREEQYNSTYRVVSVLTVLHQDWLNGKEYKCKVSNKALPAPIEKTISKAKGQPREPQVYTLPPSQEEMTKNQVSLTCLVKGFYPSDIAVEWESSGQPENNYNTIPPMLDSDGSFFLYSKLTVDKSRWQEGNVFSCSVMHEALHNHYTQKSLSLSPGSSDKTHTSPPSPSGEVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSS

SEQ ID NO: 105 - protein, 574 aa, Artificial Sequence
  Heavy Chain 2 of anti-CD19 x anti-CD3 mAb-Fv [HC ISO(+RR) (VL)] (Figure 66)
EVQLVESGGGLVKPGGSLKLSCAASGYTFTSYVMHWVRQAPGKGLEWIGYINPYNDGTKYNEKFQGRVTISSDKSISTAYMELSSLRSEDTAMYYCARGTYYYGTRVFDYWGQGTLVTVSSASTKGPSVFPLAPSSKSTSGGTAALGCLVKDYFPEPVTVSWNSGALTSGVHTFPAVLQSSGLYSLSSVVTVPSSSLGTKTYTCNVNHKPSNTKVDKKVERKSCDKTHTCPRCPAPELLGGPSVFLFPPKPKDTLMISRTPEVTCVVVDVSHEDPEVKFKWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTIPPVLDSDGSFFLYSKLTVDKSRWQQGNVFSCSVMHEALHNHYTQKSLSLSPGKSSDKTHTSPPSPSGQAVVTQEPSLTVSPGGTVTLTCGSSTGAVTISNYANWVQQKPGQAPRGLIGGTNKRAPGVPARFSGSLLGGKAALTLSGAQPEDEAEYYCALWYSNLWVFGGGTKLTVL

SEQ ID NO: 106 - protein, 219 aa, Artificial Sequence
  Light Chain of anti-CD19 x anti-CD3 mAb-Fv  (Figure 66)
DIVMTQSPATLSLSPGERATLSCRSSKSLQNVNGNTYLYWFQQKPGQSPQLLIYRMSNLNSGVPDRFSGSGSGTEFTLTISSLEPEDFAVYYCMQHLEYPITFGAGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 107 - protein, 231 aa, Artificial Sequence
  Heavy Chain 1 of anti-CD19 x anti-CD3 scFv2-Fc [HC ISO(-)] (Figure 67)
EPKSSDKTHTCPPCPAPELLGGPSVFLFPPKPKDTLMISRTPEVTCVVVDVSHEDPEVQFNWYVDGVEVHNAKTKPREEQYNSTYRVVSVLTVLHQDWLNGKEYKCKVSNKALPAPIEKTISKAKGQPREPQVYTLPPSQEEMTKNQVSLTCLVKGFYPSDIAVEWESSGQPENNYNTTPPMLDSDGSFFLYSKLTVDKSRWQEGNVFSCSVMHEALHNHYTQKSLSLSPG

SEQ ID NO: 108 - protein, 735 aa, Artificial Sequence [sequence omitted]

SEQ ID NO: 109 - protein, 483 aa, Artificial Sequence
  Heavy Chain 1 of anti-CD19 x anti-CD3 DART-Fc [HC ISO(-) (anti-CD19 VL/anti-CD3 VH  (Figure 68)
DIVMTQSPATLSLSPGERATLSCRSSKSLQNVNGNTYLYWFQQKPGQSPQLLIYRMSNLNSGVPDRFSGSGSGTEFTLTISSLEPEDFAVYYCMQHLEYPITFGAGTKLEIKGGGGSGGGGSGGGGSEVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSEPKSSDKTHTCPPCPAPELLGGPSVFLFPPKPKDTLMISRTPEVTCVVVDVSHEDPEVQFNWYVDGVEVHNAKTKPREEQYNSTYRVVSVLTVLHQDWLNGKEYKCKVSNKALPAPIEKTISKAKGQPREPQVYTLPPSQEEMTKNQVSLTCLVKGFYPSDIAVEWESSGQPENNYNTIPPMLDSDGSFFLYSKLTVDKSRWQEGNVFSCSVMHEALHNHYTQKSLSLSPG

SEQ ID NO: 110 - protein, 477 aa, Artificial Sequence
  Heavy Chain 2 of anti-CD19 x anti-CD3 DART-Fc [HC ISO(+RR) (anti-CD3 VL/anti-CD19 VH)]  (Figure 68)
QAVVTQEPSLTVSPGGTVTLTCGSSTGAVTISNYANWVQQKPGQAPRGLIGGTNKRAPGVPARFSGSLLGGKAALTLSGAQPEDEAEYYCALWYSNLWVFGGGTKLTVLGGGGSGGGGSGGGGSEVQLVESGGGLVKPGGSLKLSCAASGYTFTSYVMHWVRQAPGKGLEWIGYINPYNDGTKYNEKFQGRVTISSDKSISTAYMELSSLRSEDTAMYYCARGTYYYGTRVFDYWGQGTLVTVSSERKSSDKTHTCPRCPAPELLGGPSVFLFPPKPKDTLMISRTPEVTCVVVDVSHEDPEVKFKWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTIPPVLDSDGSFFLYSKLTVDKSRWQQGNVFSCSVMHEALHNHYTQKSLSLSPGK

SEQ ID NO: 111 - protein, 479 aa, Artificial Sequence
  Heavy Chain 1 of anti-CD19 x anti-CD3 scFv-Fc [HC ISO(-) (anti-CD19 scFv)J  (Figure 69)
EVQLVESGGGLVKPGGSLKLSCAASGYTFTSYVMHWVRQAPGKGLEWIGYINPYNDGTKYNEKFQGRVTISSDKSISTAYMELSSLRSEDTAMYYCARGTYYYGTRVFDYWGQGTLVTVSSGGGGSGGGGSGGGGSDIVMTQSPATLSLSPGERATLSCRSSKSLQNVNGNTYLYWFQQKPGQSPQLLIYRMSNLNSGVPDRFSGSGSGTEFTLTISSLEPEDFAVYYCMQHLEYPITFGAGTKLEIKEPKSSDKTHTCPPCPAPELLGGPSVFLFPPKPKDTLMISRTPEVTCVVVDVSHEDPEVQFNWYVDGVEVHNAKTKPREEQYNSTYRVVSVLTVLHQDWLNGKEYKCKVSNKALPAPIEKTISKAKGQPREPQVYTLPPSQEEMTKNQVSLTCLVKGFYPSDIAVEWESSGQPENNYNTIPPMLDSDGSFFLYSKLTVDKSRWQEGNVFSCSVMHEALHNHYTQKSLSLSPG

SEQ ID NO: 112 - protein, 481 aa, Artificial Sequence
  Heavy Chain 2 of anti-CD19 x anti-CD3 scFv-Fc [HC ISO(+RR) (anti-CD3 scFv)]  (Figure 69)
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTISNYANWVQQKPGQAPRGLIGGTNKRAPGVPARFSGSLLGGKAALTLSGAQPEDEAEYYCALWYSNLWVFGGGTKLTVLERKSSDKTHTCPRCPAPELLGGPSVFLFPPKPKDTLMISRTPEVTCVVVDVSHEDPEVKFKWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 113 - protein, 450 aa, Artificial Sequence
  Heavy Chain 1 of anti-CD19 x anti-CD3 mAb-scFv [HC ISO(-)] (Figure 70)
EVQLVESGGGLVKPGGSLKLSCAASGYTFTSYVMHWVRQAPGKGLEWIGYINPYNDGTKYNEKFQGRVTISSDKSISTAYMELSSLRSEDTAMYYCARGTYYYGTRVFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYTCNVDHKPSNTKVDKKVEPKSCDKTHTCPPCPAPELLGGPSVFLFPPKPKDTLMISRTPEVTCVVVDVSHEDPEVQFNWYVDGVEVHNAKTKPREEQYNSTYRVVSVLTVLHQDWLNGKEYKCKVSNKALPAPIEKTISKAKGQPREPQVYTLPPSQEEMTKNQVSLTCLVKGFYPSDIAVEWESSGQPENNYNTIPPMLDSDGSFFLYSKLTVDKSRWQEGNVFSCSVMHEALHNHYTQKSLSLSPG

SEQ ID NO: 114 - protein, 710 aa, Artificial Sequence
  Heavy Chain 2 of anti-CD19 x anti-CD3 mAb-scFv [HC ISO(+RR) (scFv)J  (Figure 70)
EVQLVESGGGLVKPGGSLKLSCAASGYTFTSYVMHWVRQAPGKGLEWIGYINPYNDGTKYNEKFQGRVTISSDKSISTAYMELSSLRSEDTAMYYCARGTYYYGTRVFDYWGQGTLVTVSSASTKGPSVFPLAPSSKSTSGGTAALGCLVKDYFPEPVTVSWNSGALTSGVHTFPAVLQSSGLYSLSSVVTVPSSSLGTKTYTCNVNHKPSNTKVDKKVERKSCDKTHTCPRCPAPELLGGPSVFLFPPKPKDTLMISRTPEVTCVVVDVSHEDPEVKFKWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTIPPVLDSDGSFFLYSKLTVDKSRWQQGNVFSCSVMHEALHNHYTQKSLSLSPGKGGGGSGGGGSEVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTISNYANWVQQKPGQAPRGLIGGTNKRAPGVPARFSGSLLGGKAALTLSGAQPEDEAEYYCALWYSNLWVFGGGTKLTVL

SEQ ID NO: 115 - protein, 219 aa, Artificial Sequence; identical to SEQ ID NO: 106
  Light Chain of anti-CD19 x anti-CD3 mAb-scFv  (Figure 70)

SEQ ID NO: 116 - protein, 450 aa, Artificial Sequence; identical to SEQ ID NO: 113
  Heavy Chain 1 of anti-CD19 x anti-CD3 mAb-dAb [HC ISO(-)] (Figure 71)

SEQ ID NO: 117 - protein, 586 aa, Artificial Sequence
  Heavy Chain 2 of anti-CD19 x anti-CD3 mAb-dAb [ISO(+RR) (scFv)J (Figure 71)
EVQLVESGGGLVKPGGSLKLSCAASGYTFTSYVMHWVRQAPGKGLEWIGYINPYNDGTKYNEKFQGRVTISSDKSISTAYMELSSLRSEDTAMYYCARGTYYYGTRVFDYWGQGTLVTVSSASTKGPSVFPLAPSSKSTSGGTAALGCLVKDYFPEPVTVSWNSGALTSGVHTFPAVLQSSGLYSLSSVVTVPSSSLGTKTYTCNVNHKPSNTKVDKKVERKSCDKTHTCPRCPAPELLGGPSVFLFPPKPKDTLMISRTPEVTCVVVDVSHEDPEVKFKWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTIPPVLDSDGSFFLYSKLTVDKSRWQQGNVFSCSVMHEALHNHYTQKSLSLSPGKGGGGSGGGGSEVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSS

SEQ ID NO: 118 - protein, 219 aa, Artificial Sequence; identical to SEQ ID NO: 106
  Light Chain of anti-CD19 x anti-CD3 mAb-dAb  (Figure 71)

SEQ ID NO: 119 - protein, 566 aa, Artificial Sequence
  Heavy Chain 1 of anti-CD19 x anti-CD3 Fv-Fab-Fc [HC ISO(-) (VL-VL-CL)]  (Figure 72)
DIVMTQSPATLSLSPGERATLSCRSSKSLQNVNGNTYLYWFQQKPGQSPQLLIYRMSNLNSGVPDRFSGSGSGTEFTLTISSLEPEDFAVYYCMQHLEYPITFGAGTKLEIKTVAAPSVFIFPPQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVLRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECDKTHTCPPCPAPELLGGPSVFLFPPKPKDTLMISRTPEVTCVVVDVSHEDPEVQFNWYVDGVEVHNAKTKPREEQYNSTYRVVSVLTVLHQDWLNGKEYKCKVSNKALPAPIEKTISKAKGQPREPQVYTLPPSQEEMTKNQVSLTCLVKGFYPSDIAVEWESSGQPENNYNTIPPMLDSDGSFFLYSKLTVDKSRWQEGNVFSCSVMHEALHNHYTQKSLSLSPG

SEQ ID NO: 120 - protein, 589 aa, Artificial Sequence
  Heavy Chain 2 of anti-CD19 x anti-CD3 Fv-Fab-Fc [HC ISO(+RR) (VH-VH-CHl)]  (Figure 72)
EVQLVESGGGLVKPGGSLKLSCAASGYTFTSYVMHWVRQAPGKGLEWIGYINPYNDGTKYNEKFQGRVTISSDKSISTAYMELSSLRSEDTAMYYCARGTYYYGTRVFDYWGQGTLVTVSSASTKGPSVFPLAPEVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSASTKGPSVFPLAPSSKSTSGGTAALGCLVKDYFPEPVTVSWNSGALTSGVHTFPAVLQSSGLYSLSSVVTVPSSSLGTKTYTCNVNHKPSNTKVDKKVERKSSDKTHTCPRCPAPELLGGPSVFLFPPKPKDTLMISRTPEVTCVVVDVSHEDPEVKFKWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTIPPVLDSDGSFFLYSKLTVDKSRWQQGNVFSCSVMHEALHNHYTQKSLSLSPGK

SEQ ID NO: 121 - protein, 450 aa, Artificial Sequence; identical to SEQ ID NO: 113
  Heavy Chain 1 of anti-CD19 x anti-CD3 common light chain mAb [HC ISO(-) (anti-CD19 Fab with antiCD19 VH-CH1/anti-CD3 LC)]  (Figure 73)

SEQ ID NO: 122 - protein, 455 aa, Artificial Sequence
  Heavy Chain 2 of anti-CD19 x anti-CD3 common light chain mAb ISO(+RR) [(anti-CD3 Fab with antiCD3 VH-CH1/anti-CD3 LC)l (Figure 73)
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSASTKGPSVFPLAPSSKSTSGGTAALGCLVKDYFPEPVTVSWNSGALTSGVHTFPAVLQSSGLYSLSSVVTVPSSSLGTKTYTCNVNHKPSNTKVDKKVERKSCDKTHTCPRCPAPELLGGPSVFLFPPKPKDTLMISRTPEVTCVVVDVSHEDPEVKFKWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTIPPVLDSDGSFFLYSKLTVDKSRWQQGNVFSCSVMHEALHNHYTQKSLSLSPGK

SEQ ID NO: 123 - protein, 216 aa, Artificial Sequence
  Light Chain of anti-CD19 x anti-CD3 common light chain mAb (Figure 73)
QAVVTQEPSLTVSPGGTVTLTCGSSTGAVTISNYANWVQQKPGQAPRGLIGGTNKRAPGVPARFSGSLLGGKAALTLSGAQPEDEAEYYCALWYSNLWVFGGGTKLTVLRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 124 - protein, 231 aa, Artificial Sequence; identical to SEQ ID NO: 107
  Heavy Chain 1 of anti-CD3 one-arm mAb [HC ISO(-)]  (Figure 74)

SEQ ID NO: 125 - protein, 455 aa, Artificial Sequence
  Heavy Chain 2 of anti-CD3 one-arm mAb [HC ISO(+RR) (anti-CD3 Fab)]  (Figure 74)
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSASTKGPSVFPLAPSSKSTSGGTAALGCLVKDYFPEPVTVSWNSGALTSGVHTFPAVLQSSGLYSLSSVVTVPSSSLGTKTYTCNVNHKPSNTKVDKKVERKSCDKTHTCPRCPAPELLGGPSVFLFPPKPKDTLMISRTPEVTCVVVDVSHEDPEVKFKWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 126 - protein, 216 aa, Artificial Sequence
  Light Chain of anti-CD3 one-arm mAb  (Figure 74)
QAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVLRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 127 - protein, 571 aa, Artificial Sequence
  Heavy Chain 1 of anti-CD19 x anti-CD3 Fab-Fv-Fc [HC ISO(-) (VL-CL-VL)]  (Figure 75)
DIVMTQSPATLSLSPGERATLSCRSSKSLQNVNGNTYLYWFQQKPGQSPQLLIYRMSNLNSGVPDRFSGSGSGTEFTLTISSLEPEDFAVYYCMQHLEYPITFGAGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECTVAAPSVFIFPPQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVLEPKSSDKTHTCPPCPAPELLGGPSVFLFPPKPKDTLMISRTPEVTCVVVDVSHEDPEVQFNWYVDGVEVHNAKTKPREEQYNSTYRVVSVLTVLHQDWLNGKEYKCKVSNKALPAPIEKTISKAKGQPREPQVYTLPPSQEEMTKNQVSLTCLVKGFYPSDIAVEWESSGQPENNYNTIPPMLDSDGSFFLYSKLTVDKSRWQEGNVFSCSVMHEALHNHYTQKSLSLSPG

SEQ ID NO: 128 - protein, 594 aa, Artificial Sequence
  Heavy Chain 2 of anti-CD19 x anti-CD3 Fab-Fv-Fc [HC ISO(+RR) (VH-CHl-VH)]  (Figure 75)
EVQLVESGGGLVKPGGSLKLSCAASGYTFTSYVMHWVRQAPGKGLEWIGYINPYNDGTKYNEKFQGRVTISSDKSISTAYMELSSLRSEDTAMYYCARGTYYYGTRVFDYWGQGTLVTVSSASTKGPSVFPLAPSSKSTSGGTAALGCLVKDYFPEPVTVSWNSGALTSGVHTFPAVLQSSGLYSLSSVVTVPSSSLGTKTYTCNVNHKPSNTKVDKKVERKSCASTKGPSVFPLAPEVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSERKSSDKTHTCPRCPAPELLGGPSVFLFPPKPKDTLMISRTPEVTCVVVDVSHEDPEVKFKWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTIPPVLDSDGSFFLYSKLTVDKSRWQQGNVFSCSVMHEALHNHYTQKSLSLSPGK

SEQ ID NO: 129 - protein, 464 aa, Artificial Sequence
  Heavy Chain 1 of anti-CD19 x anti-CD3 Fv-Fv-Fc [HC ISO(-) (VL-VL)]  (Figure 76)
DIVMTQSPATLSLSPGERATLSCRSSKSLQNVNGNTYLYWFQQKPGQSPQLLIYRMSNLNSGVPDRFSGSGSGTEFTLTISSLEPEDFAVYYCMQHLEYPITFGAGTKLEIKTVAAPSVFIFPPQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVLEPKSSDKTHTCPPCPAPELLGGPSVFLFPPKPKDTLMISRTPEVTCVVVDVSHEDPEVQFNWYVDGVEVHNAKTKPREEQYNSTYRVVSVLTVLHQDWLNGKEYKCKVSNKALPAPIEKTISKAKGQPREPQVYTLPPSQEEMTKNQVSLTCLVKGFYPSDIAVEWESSGQPENNYNTIPPMLDSDGSFFLYSKLTVDKSRWQEGNVFSCSVMHEALHNHYTQKSLSLSPG

SEQ ID NO: 130 - protein, 491 aa, Artificial Sequence
  Heavy Chain 2 of anti-CD19 x anti-CD3 Fv-Fv-Fc [HC ISO(+RR) (VH-VH)]  (Figure 76)
EVQLVESGGGLVKPGGSLKLSCAASGYTFTSYVMHWVRQAPGKGLEWIGYINPYNDGTKYNEKFQGRVTISSDKSISTAYMELSSLRSEDTAMYYCARGTYYYGTRVFDYWGQGTLVTVSSASTKGPSVFPLAPEVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSERKSSDKTHTCPRCPAPELLGGPSVFLFPPKPKDTLMISRTPEVTCVVVDVSHEDPEVKFKWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTIPPVLDSDGSFFLYSKLTVDKSRWQQGNVFSCSVMHEALHNHYTQKSLSLSPGK

SEQ ID NO: 131 - protein, 442 aa, Artificial Sequence
  Heavy Chain 1 of anti-CD3 monovalent mAb [HC ISO(-) (VL-CL)] (Figure 77)
QAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVLRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECDKTHTCPPCPAPELLGGPSVFLFPPKPKDTLMISRTPEVTCVVVDVSHEDPEVQFNWYVDGVEVHNAKTKPREEQYNSTYRVVSVLTVLHQDWLNGKEYKCKVSNKALPAPIEKTISKAKGQPREPQVYTLPPSQEEMTKNQVSLTCLVKGFYPSDIAVEWESSGQPENNYNTIPPMLDSDGSFFLYSKLTVDKSRWQEGNVFSCSVMHEALHNHYTQKSLSLSPG

SEQ ID NO: 132 - protein, 455 aa, Artificial Sequence; identical to SEQ ID NO: 122
  Heavy Chain 2 of anti-CD3 monovalent mAb [HC ISO(+RR) (VH-CHl)] (Figure 77)

SEQ ID NO: 133 - protein, 593 aa, Artificial Sequence
  Heavy Chain 1 of anti-CD19 x anti-CD3 central Fv [HC ISO(-) (Fab-VH)J  (Figure 78)
EVQLVESGGGLVKPGGSLKLSCAASGYTFTSYVMHWVRQAPGKGLEWIGYINPYNDGTKYNEKFQGRVTISSDKSISTAYMELSSLRSEDTAMYYCARGTYYYGTRVFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYTCNVDHKPSNTKVDKKVEPKSCASTKGPSVFPLAPEVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSEPKSSDKTHTCPPCPAPELLGGPSVFLFPPKPKDTLMISRTPEVTCVVVDVSHEDPEVQFNWYVDGVEVHNAKTKPREEQYNSTYRVVSVLTVLHQDWLNGKEYKCKVSNKALPAPIEKTISKAKGQPREPQVYTLPPSQEEMTKNQVSLTCLVKGFYPSDIAVEWESSGQPENNYNTTPPMLDSDGSFFLYSKLTVDKSRWQEGNVFSCSVMHEALHNHYTQKSLSLSPG

SEQ ID NO: 134 - protein, 577 aa, Artificial Sequence
  Heavy Chain 2 of anti-CD19 x anti-CD3 central Fv [HC ISO(+RR) (Fab-VL)J  (Figure 78)
EVQLVESGGGLVKPGGSLKLSCAASGYTFTSYVMHWVRQAPGKGLEWIGYINPYNDGTKYNEKFQGRVTISSDKSISTAYMELSSLRSEDTAMYYCARGTYYYGTRVFDYWGQGTLVTVSSASTKGPSVFPLAPSSKSTSGGTAALGCLVKDYFPEPVTVSWNSGALTSGVHTFPAVLQSSGLYSLSSVVTVPSSSLGTKTYTCNVNHKPSNTKVDKKVEPKSCTVAAPSVFIFPPQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVLERKSSDKTHTCPRCPAPELLGGPSVFLFPPKPKDTLMISRTPEVTCVVVDVSHEDPEVKFKWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 135 - protein, 219 aa, Artificial Sequence; identical to SEQ ID NO: 106
  Light Chain of anti-CD19 x anti-CD3 central Fv  (Figure 78)

SEQ ID NO: 136 - protein, 673 aa, Artificial Sequence
  Heavy Chain 1 of anti-CD19 x anti-CD3 Fab-Fab-Fc [HC ISO(-) (VL-CL-VL-CL)]  (Figure 79)
DIVMTQSPATLSLSPGERATLSCRSSKSLQNVNGNTYLYWFQQKPGQSPQLLIYRMSNLNSGVPDRFSGSGSGTEFTLTISSLEPEDFAVYYCMQHLEYPITFGAGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECTVAAPSVFIFPPQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVLRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECDKTHTCPPCPAPELLGGPSVFLFPPKPKDTLMISRTPEVTCVVVDVSHEDPEVQFNWYVDGVEVHNAKTKPREEQYNSTYRVVSVLTVLHQDWLNGKEYKCKVSNKALPAPIEKTISKAKGQPREPQVYTLPPSQEEMTKNQVSLTCLVKGFYPSDIAVEWESSGQPENNYNTIPPMLDSDGSFFLYSKLTVDKSRWQEGNVFSCSVMHEALHNHYTQKSLSLSPG

SEQ ID NO: 137 - protein, 692 aa, Artificial Sequence
  Heavy Chain 2 of anti-CD19 x anti-CD3 Fab-Fab-Fc [HC ISO(+RR) (VH-CHl-VH-CHl)]  (Figure 79)
EVQLVESGGGLVKPGGSLKLSCAASGYTFTSYVMHWVRQAPGKGLEWIGYINPYNDGTKYNEKFQGRVTISSDKSISTAYMELSSLRSEDTAMYYCARGTYYYGTRVFDYWGQGTLVTVSSASTKGPSVFPLAPSSKSTSGGTAALGCLVKDYFPEPVTVSWNSGALTSGVHTFPAVLQSSGLYSLSSVVTVPSSSLGTKTYTCNVNHKPSNTKVDKKVERKSCASTKGPSVFPLAPEVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSASTKGPSVFPLAPSSKSTSGGTAALGCLVKDYFPEPVTVSWNSGALTSGVHTFPAVLQSSGLYSLSSVVTVPSSSLGTKTYTCNVNHKPSNTKVDKKVERKSCDKTHTCPRCPAPELLGGPSVFLFPPKPKDTLMISRTPEVTCVVVDVSHEDPEVKFKWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTIPPVLDSDGSFFLYSKLTVDKSRWQQGNVFSCSVMHEALHNHYTQKSLSLSPGK

SEQ ID NO: 138 - protein, 479 aa, Artificial Sequence
  Heavy Chain 1 of XENP11355 anti-CD19 x anti-CD3 dual scFv-Fc [HC ISO(-) (anti-CD19 scFv)J  (Figure 80)
EVQLVESGGGLVKPGGSLKLSCAASGYTFTSYVMHWVRQAPGKGLEWIGYINPYNDGTKYNEKFQGRVTISSDKSISTAYMELSSLRSEDTAMYYCARGTYYYGTRVFDYWGQGTLVTVSSGGGGSGGGGSGGGGSDIVMTQSPATLSLSPGERATLSCRSSKSLQNVNGNTYLYWFQQKPGQSPQLLIYRMSNLNSGVPDRFSGSGSGTEFTLTISSLEPEDFAVYYCMQHLEYPITFGAGTKLEIKEPKSSDKTHTCPPCPAPELLRGPSVFLFPPKPKDTLMISRTPEVTCVVVDVSHEDPEVQFNWYVDGVEVHNAKTKPREEQYNSTYRVVSVLTVLHQDWLNGKEYKCKVSNKARPAPIEKTISKAKGQPREPQVYTLPPSQEEMTKNQVSLTCLVKGFYPSDIAVEWESSGQPENNYNTTPPMLDSDGSFFLYSKLTVDKSRWQEGNVFSCSVMHEALHNHYTQKSLSLSPG

SEQ ID NO: 139 - protein, 481 aa, Artificial Sequence
  Heavy Chain 2 of XENP11355 anti-CD19 x anti-CD3 dual scFv-Fc [HC ISO(+RR) (anti-CD3 scFv)J  (Figure 80)
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVLERKSSDKTHTCPRCPAPELLRGPSVFLFPPKPKDTLMISRTPEVTCVVVDVSHEDPEVKFKWYVDGVEVHNAKTKPREEQYNSTYRVVSVLTVLHQDWLNGKEYKCKVSNKARPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 140 - protein, 476 aa, Artificial Sequence
  Heavy Chain 1 of XENP11139 anti-CD19 x anti-CD32b dual scFv-Fc [HC ISO(-) (anti-CD32b scFv)J  (Figure 82)
EVQLVESGGGLVSPGGSLKLSCVASGFAFSSYDMSWVRQTPEKRLEWVAKINSAGGRTNYPDTVKGRFTISRDNAENTLYLQMSSLKSEDTAMYYCAGHSYDYPFTYWGQGTLVTVSAGGGGSGGGGSGGGGSGGGGSDVVLTQSPATLSVTPGDSVSLSCRASQGISNNLHWYQQKSHESPRLLIKYASQSISGIPSRFSGSGSGTDFTLSINSVETEDFGMYFCQQSDSWPHTFGGGTKLEIKEPKSSDKTHTCPPCPAPELLRGPSVFLFPPKPKDTLMISRTPEVTCVVVDVSHEDPEVQFNWYVDGVEVHNAKTKPREEQYNSTYRVVSVLTVLHQDWLNGKEYKCKVSNKARPAPIEKTISKAKGQPREPQVYTLPPSQEEMTKNQVSLTCLVKGFYPSDIAVEWESSGQPENNYNTIPPMLDSDGSFFLYSKLTVDKSRWQEGNVFSCSVMHEALHNHYTQKSLSLSPG

SEQ ID NO: 141 - protein, 485 aa, Artificial Sequence
  Heavy Chain 2 of XENP11139 anti-CD19 x anti-CD32b dual scFv-Fc [HC ISO(+) (anti-CD19 scFv)J  (Figure 82)
EVQLVESGGGLVKPGGSLKLSCAASGYTFTSYVMHWVRQAPGKGLEWIGYINPYNDGTKYNEKFQGRVTISSDKSISTAYMELSSLRSEDTAMYYCARGTYYYGTRVFDYWGQGTLVTVSSGGGGSGGGGSGGGGSGGGGSDIVMTQSPATLSLSPGERATLSCRSSKSLQNVNGNTYLYWFQQKPGQSPQLLIYRMSNLNSGVPDRFSGSGSGTEFTLTISSLEPEDFAVYYCMQHLEYPITFGAGTKLEIKEPKSSDKTHTCPPCPAPELLRGPSVFLFPPKPKDTLMISRTPEVTCVVVDVSHEDPEVKFKWYVDGVEVHNAKTKPREEQYNSTYRVVSVLTVLHQDWLNGKEYKCKVSNKARPAPIEKTISKAKGQPREPQVYTLPPSREEMTKNQVSLTCLVKGFYPSDIAVEWESNGQPENNYKTIPPVLDSDGSFFLYSKLTVDKSRWQQGNVFSCSVMHEALHNHYTQKSLSLSPGK

SEQ ID NO: 142 - protein, 479 aa, Artificial Sequence; identical to SEQ ID NO: 138
  Heavy Chain 1 of XENP11338 anti-CD19 x anti-CD3 dual scFv-Fc [HC ISO(-) (anti-CD19 scFv)J  (Figure 84)

SEQ ID NO: 143 - protein, 442 aa, Artificial Sequence
  Heavy Chain 2 of XENP11338 anti-CD19 x anti-CD3 dual scFv-Fc [HC ISO(+) (anti-CD3 scFv)J  (Figure 84)
DIQLQQSGPGLVKPSQSLSLTCSVTGYSITTNYNWNWIRQFPGNKLEWMGYIRYDGTSEYTPSLKNRVSITRDTSMNQFFLRLTSVTPEDTATYYCARLDYWGQGTSVTVSSASTKGPSVFPLAPSSKSTSGGTAALGCLVKDYFPEPVTVSWNSGALTSGVHTFPAVLQSSGLYSLSSVVTVPSSSLGTKTYTCNVNHKPSNTKVDKKVEPKSCDKTHTCPPCPAPELLRGPSVFLFPPKPKDTLMISRTPEVTCVVVDVSHEDPEVKFKWYVDGVEVHNAKTKPREEQYNSTYRVVSVLTVLHQDWLNGKEYKCKVSNKARPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 144 - protein, 445 aa, Artificial Sequence [sequence omitted]

SEQ ID NO: 145 - protein, 442 aa, Artificial Sequence; identical to SEQ ID NO: 143
  Heavy Chain 2 of XENP11233 anti-CD40 monovalent mAb [HC ISO(+) (anti-CD40 VH-CHl)]  (Figure 86)

SEQ ID NO: 146 - protein, 231 aa, Artificial Sequence
  Heavy Chain 1 of XENP11238 anti-CD40 one-arm mAb [HC ISO(-)] (Figure 88)
EPKSSDKTHTCPPCPAPELLRGPSVFLFPPKPKDTLMISRTPEVTCVVVDVSHEDPEVQFNWYVDGVEVHNAKTKPREEQYNSTYRVVSVLTVLHQDWLNGKEYKCKVSNKARPAPIEKTISKAKGQPREPQVYTLPPSQEEMTKNQVSLTCLVKGFYPSDIAVEWESSGQPENNYNTIPPMLDSDGSFFLYSKLTVDKSRWQEGNVFSCSVMHEALHNHYTQKSLSLSPG

SEQ ID NO: 147 - protein, 443 aa, Artificial Sequence
  Heavy Chain 2 of XENP11238 anti-CD40 one-arm mAb [HC ISO(+) (anti-CD40 Fa b)]  (Figure 88)
QVKLEESGPGLVAPSQSLSITCTVSGFSLSRYSVYWVRQPPGKGLEWLGMMWGGGSTDYNSALKSRLSISKDTSKSQVFLKMNSLQTDDTAMYYCVRTDGDYWGQGTSVTVSSASTKGPSVFPLAPSSKSTSGGTAALGCLVKDYFPEPVTVSWNSGALTSGVHTFPAVLQSSGLYSLSSVVTVPSSSLGTKTYTCNVNHKPSNTKVDKKVEPKSCDKTHTCPPCPAPELLRGPSVFLFPPKPKDTLMISRTPEVTCVVVDVSHEDPEVKFKWYVDGVEVHNAKTKPREEQYNSTYRVVSVLTVLHQDWLNGKEYKCKVSNKARPAPIEKTISKAKGQPREPQVYTLPPSREEMTKNQVSLTCLVKGFYPSDIAVEWESNGQPENNYKTIPPVLDSDGSFFLYSKLTVDKSRWQQGNVFSCSVMHEALHNHYTQKSLSLSPGK

SEQ ID NO: 148 - protein, 219 aa, Artificial Sequence; identical to SEQ ID NO: 48
  Light Chain of XENP11238 anti-CD40 one-arm mAb [LC (anti-CD40 Fa b)]  (Figure 88)

SEQ ID NO: 149 - protein, 330 aa, Artificial Sequence; identical to SEQ ID NO: 2
  IgG1-WT  (Figure 92A)

SEQ ID NO: 150 - protein, 326 aa, Artificial Sequence
  IgG2-WT  (Figure 92A)
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 151 - protein, 332 aa, Artificial Sequence
  IgG3-WT  (Figure 92A)
ASTKGPSVFPLAPCSRSTSGGTAALGCLVKDYFPEPVTVSWNSGALTSGVHTFPAVLQSSGLYSLSSVVTVPSSSLGTQTYTCNVNHKPSNTKVDKRVELKTPLGDTTHTCPRCPAPELLGGPSVFLFPPKPKDTLMISRTPEVTCVVVDVSHEDPEVQFKWYVDGVEVHNAKTKPREEQYNSTFRVVSVLTVLHQDWLNGKEYKCKVSNKALPAPIEKTISKTKGQPREPQVYTLPPSREEMTKNQVSLTCLVKGFYPSDIAVEWESSGQPENNYNTTPPMLDSDGSFFLYSKLTVDKSRWQQGNIFSCSVMHEALHNRFTQKSLSLSPGK

SEQ ID NO: 152 - protein, 327 aa, Artificial Sequence
  IgG4-WT  (Figure 92A)
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 153 - protein, 329 aa, Artificial Sequence
  IgG1/2-HC  (Figure 92A)
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 154 - protein, 330 aa, Artificial Sequence
  IgG1-434S  (Figure 92B)
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHSHYTQKSLSLSPGK

SEQ ID NO: 155 - protein, 326 aa, Artificial Sequence
  IgG2-434S  (Figure 92B)
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHSHYTQKSLSLSPGK

SEQ ID NO: 156 - protein, 330 aa, Artificial Sequence
  IgG1-CH1-pI(6)  (Figure 92B)
AETKGPSVFPLAPSSESTSGGTAALGCLVKDYFPEPVTVSWNSGALESGVHTFPAVLQSSGLYSLSSVVTVPSSSLGTQTYICNVNHEPSDTEVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 157 - protein, 330 aa, Artificial Sequence; identical to SEQ ID NO: 2
  IgG1-WT  (Figure 92B)

SEQ ID NO: 158 - protein, 330 aa, Artificial Sequence; identical to SEQ ID NO: 156
  IgG1-CH1-pI(6)  (Figure 92B)

SEQ ID NO: 159 - protein, 330 aa, Artificial Sequence
  IgG1-CH1-pI(6)-434S  (Figure 92B)
AETKGPSVFPLAPSSESTSGGTAALGCLVKDYFPEPVTVSWNSGALESGVHTFPAVLQSSGLYSLSSVVTVPSSSLGTQTYICNVNHEPSDTEVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHSHYTQKSLSLSPGK

SEQ ID NO: 160 - protein, 330 aa, Artificial Sequence
  IgG1-CH1-pI(6)-428L/434S  (Figure 92C)
AETKGPSVFPLAPSSESTSGGTAALGCLVKDYFPEPVTVSWNSGALESGVHTFPAVLQSSGLYSLSSVVTVPSSSLGTQTYICNVNHEPSDTEVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 161 - protein, 330 aa, Artificial Sequence; identical to SEQ ID NO: 2
  IgG1-WT  (Figure 92C)

SEQ ID NO: 162 - protein, 330 aa, Artificial Sequence; identical to SEQ ID NO: 2
  IgG1-WT  (Figure 92C)

SEQ ID NO: 163 - protein, 326 aa, Artificial Sequence; identical to SEQ ID NO: 150
  IgG2-WT  (Figure 92C)

SEQ ID NO: 164 - protein, 326 aa, Artificial Sequence; identical to SEQ ID NO: 150
  IgG2-WT  (Figure 92C)

SEQ ID NO: 165 - protein, 326 aa, Artificial Sequence; identical to SEQ ID NO: 150
  IgG2-WT  (Figure 92C)

SEQ ID NO: 166 - protein, 329 aa, Artificial Sequence
  pI-Iso1  (Figure 92D)
ASTKGPSVFPLAPSSKSTSESTAALGCLVKDYFPEPVTVSWNSGALTSGVHTFPAVLQSSGLYSLSSVVTVPSSSLGTQTYTCNVDHKPSNTKVDKTVEPKSCDTTHTCPPCPAPELLGGPSVFLFPPKPKDTLMISRTPEVTCVVVDVSHEDPEVQFNWYVDGVEVHNAKTKPREEQYNSTYRVVSVLTVLHQDWLNGKEYKCKVSNKALPAPIEKTISKAKGQPREPQVYTLPPSQEEMTKNQVSLTCLVKGFYPSDIAVEWESSGQPENNYNTTPPMLDSDGSFFLYSKLTVDKSRWQEGNVFSCSVMHEALHNHYTQKSLSLSPG

SEQ ID NO: 167 - protein, 329 aa, Artificial Sequence
  pI-Iso1(NF)  (Figure 92D)
ASTKGPSVFPLAPSSKSTSESTAALGCLVKDYFPEPVTVSWNSGALTSGVHTFPAVLQSSGLYSLSSVVTVPSSNFGTQTYTCNVDHKPSNTKVDKTVEPKSCDTTHTCPPCPAPELLGGPSVFLFPPKPKDTLMISRTPEVTCVVVDVSHEDPEVQFNWYVDGVEVHNAKTKPREEQYNSTYRVVSVLTVLHQDWLNGKEYKCKVSNKALPAPIEKTISKAKGQPREPQVYTLPPSQEEMTKNQVSLTCLVKGFYPSDIAVEWESSGQPENNYNTTPPMLDSDGSFFLYSKLTVDKSRWQEGNVFSCSVMHEALHNHYTQKSLSLSPG

SEQ ID NO: 168 - protein, 326 aa, Artificial Sequence
  pI-Iso1(NF-VE)  (Figure 92D)
ASTKGPSVFPLAPSSKSTSESTAALGCLVKDYFPEPVTVSWNSGALTSGVHTFPAVLQSSGLYSLSSVVTVPSSNFGTQTYTCNVDHKPSNTKVDKTVEPKSCVECPPCPAPELLGGPSVFLFPPKPKDTLMISRTPEVTCVVVDVSHEDPEVQFNWYVDGVEVHNAKTKPREEQYNSTYRVVSVLTVLHQDWLNGKEYKCKVSNKALPAPIEKTISKAKGQPREPQVYTLPPSQEEMTKNQVSLTCLVKGFYPSDIAVEWESSGQPENNYNTTPPMLDSDGSFFLYSKLTVDKSRWQEGNVFSCSVMHEALHNHYTQKSLSLSPG

SEQ ID NO: 169 - protein, 326 aa, Artificial Sequence; identical to SEQ ID NO: 168
  pI-Iso1(NF-VE)   (Figure 92D)

SEQ ID NO: 170 - protein, 326 aa, Artificial Sequence; identical to SEQ ID NO: 168
  pI-Iso1(NF-VE)   (Figure 92D)

SEQ ID NO: 171 - protein, 326 aa, Artificial Sequence; identical to SEQ ID NO: 168
  pI-Iso1(NF-VE)   (Figure 92D)

SEQ ID NO: 172 - protein, 330 aa, Artificial Sequence
  pI-Iso1(NF-VE-DEDE)   (Figure 92E)
ASTKGPSVFPLAPSSKSTSESTAALGCLVKDYFPEPVTVSWNSGALTSGVHTFPAVLQSSGLYSLSSVVTVPSSNFGTQTYTCNVDHKPSNTKVDKTVEPKSCVECPPCPAPELLGGPSVFLFPPKPKDTLMISRTPEVTCVVVDVSHEDPEVQFNWYVDGVEVHNAKTKPREEQYNSTYRVVSVLTVLHQDWLNGKEYKCKVSNKALPAPIEKTISKAKGQPREPQVYTLPPSQEEMTKNQVSLTCLVKGFYPSDIAVEWESSGQPENNYNTTPPMLDSDGSFFLYSKLTVDKSRWQEGNVFSCSVMHEALHNHYTQKSLSLSPGDEDE

SEQ ID NO: 173 - protein, 330 aa, Artificial Sequence; identical to SEQ ID NO: 172
  pI-Iso1(NF-VE-DEDE)   (Figure 92E)

SEQ ID NO: 174 - protein, 330 aa, Artificial Sequence; identical to SEQ ID NO: 172
  XENP010105  pI-Iso1(NF-VE-DEDE)   (Figure 92E)

SEQ ID NO: 175 - protein, 330 aa, Artificial Sequence; identical to SEQ ID NO: 172
  pI-Iso1(NF-VE-DEDE)   (Figure 92E)

SEQ ID NO: 176 - protein, 329 aa, Artificial Sequence
  IgG1-pI(7)   (Figure 92E)
ASTKGPSVFPLAPSSESTSGGTAALGCLVKDYFPEPVTVSWNSGALTSGVHTFPAVLQSSGLYSLSSVVTVPSSSLGTQTYICNVNHEPSNTEVDKKVEPKSCDKTHTCPPCPAPELLGGPSVFLFPPKPKDTLMISRTPEVTCVVVDVSHEDPEVEFNWYVDGVEVHNAKTKPREEQYNSTYRVVSVLTVLHQDWLNGKEYKCKVSNKALPAPIEKTISKAKGQPREPQVYTLPPSEEEMTKNQVSLTCLVKGFYPSDIAVEWESNGQPENNYETTPPVLDSDGSFFLYSKLTVDKSRWQQGNVFSCSVMHEALHNHYTQKSLSLSPG

SEQ ID NO: 177 - protein, 329 aa, Artificial Sequence
  IgG1-pI(11)   (Figure 92E)
ASTKGPSVFPLAPSSESTSGGTAALGCLVKDYFPEPVTVSWNSGALTSGVHTFPAVLQSSGLYSLSSVVTVPSSSLGTQTYICNVNHEPSNTEVDKKVEPKSCDKTHTCPPCPAPELLGGPSVFLFPPKPKDTLMISRTPEVTCVVVDVSHEDPEVEFNWYVDGVEVHNAKTKPREEQYNSTYRVVSVLTVLHQDWLNGKEYECEVSNEALPAPIEETISKAKGQPREPQVYTLPPSEEEMTKNQVSLTCLVKGFYPSDIAVEWESNGQPENNYETTPPVLDSDGSFFLYSKLTVDKSRWQQGNVFSCSVMHEALHNHYTQKSLSLSPG

SEQ ID NO: 178 - protein, 328 aa, Artificial Sequence
  IgG1/2-pI(7)   (Figure 92F)
ASTKGPSVFPLAPSSESTSGGTAALGCLVKDYFPEPVTVSWNSGALTSGVHTFPAVLQSSGLYSLSSVVTVPSSSLGTQTYICNVNHEPSNTEVDKKVEPKSCDKTHTCPPCPAPPVAGPSVFLFPPKPKDTLMISRTPEVTCVVVDVSHEDPEVEFNWYVDGVEVHNAKTKPREEQFNSTFRVVSVLTVVHQDWLNGKEYKCKVSNKGLPAPIEKTISKTKGQPREPQVYTLPPSEEEMTKNQVSLTCLVKGFYPSDIAVEWESNGQPENNYETTPPMLDSDGSFFLYSKLTVDKSRWQQGNVFSCSVMHEALHNHYTQKSLSLSPG

SEQ ID NO: 179 - protein, 328 aa, Artificial Sequence
  IgG1/2-pI(11)  (Figure 92F)
ASTKGPSVFPLAPSSESTSGGTAALGCLVKDYFPEPVTVSWNSGALTSGVHTFPAVLQSSGLYSLSSVVTVPSSSLGTQTYICNVNHEPSNTEVDKKVEPKSCDKTHTCPPCPAPPVAGPSVFLFPPKPKDTLMISRTPEVTCVVVDVSHEDPEVEFNWYVDGVEVHNAKTKPREEQFNSTFRVVSVLTVVHQDWLNGKEYECEVSNEGLPAPIEETISKTKGQPREPQVYTLPPSEEEMTKNQVSLTCLVKGFYPSDIAVEWESNGQPENNYETTPPMLDSDGSFFLYSKLTVDKSRWQQGNVFSCSVMHEALHNHYTQKSLSLSPG

SEQ ID NO: 180 - protein, 330 aa, Artificial Sequence
  IgG1-pI(6)-Neutral-to-DE  (Figure 92F)
AETKGPSVFPLAPSSKSTSGGTAALGCLVKDYFPEPVTVSWNSGALESGVHTFPAVLQSSGLYSLSSVVTVPSSSLGTQTYICNVNHKPSDTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 181 - protein, 330 aa, Artificial Sequence
  IgG1-pI(6)-KR-to-Neutral  (Figure 92F)
ASTKGPSVFPLAPSSQSTSGGTAALGCLVKDYFPEPVTVSWNSGALTSGVHTFPAVLQSSGLYSLSSVVTVPSSSLGTQTYICNVNHQPSNTQVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 182 - protein, 330 aa, Artificial Sequence
  IgG1-pI(6)-KR-to-DE  (Figure 92F)
ASTKGPSVFPLAPSSESTSGGTAALGCLVKDYFPEPVTVSWNSGALTSGVHTFPAVLQSSGLYSLSSVVTVPSSSLGTQTYICNVNHEPSNTEVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 183 - protein, 325 aa, Artificial Sequence; identical to SEQ ID NO: 19
  IgG-pI-Iso2  (Figure 92F)

SEQ ID NO: 184 - protein, 329 aa, Artificial Sequence
  IgG-pI-Iso3  (Figure 92G)
ASTKGPSVFPLAPSSKSTSESTAALGCLVKDYFPEPVTVSWNSGALTSGVHTFPAVLQSSGLYSLSSVVTVPSSNFGTQTYTCNVDHKPSNTKVDKTVEPKSCDTTHTCPPCPAPELLGGPSVFLFPPKPKDTLMISRTPEVTCVVVDVSHEDPEVQFNWYVDGVEVHNAKTKPREEQFNSTFRVVSVLTVVHQDWLNGKEYKCKVSNKALPAPIEKTISKTKGQPREPQVYTLPPSQEEMTKNQVSLTCLVKGFYPSDIAVEWESSGQPENNYNTTPPMLDSDGSFFLYSKLTVDKSRWQEGNVFSCSVMHEALHNHYTQKSLSLSPG

SEQ ID NO: 185 - protein, 325 aa, Artificial Sequence
  IgG-pI-Iso2-434S  (Figure 92G)
ASTKGPSVFPLAPSSKSTSESTAALGCLVKDYFPEPVTVSWNSGALTSGVHTFPAVLQSSGLYSLSSVVTVPSSNFGTQTYTCNVDHKPSNTKVDKTVEPKSCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSQEEMTKNQVSLTCLVKGFYPSDIAVEWESSGQPENNYNTTPPMLDSDGSFFLYSKLTVDKSRWQEGNVFSCSVMHEALHSHYTQKSLSLSPG

SEQ ID NO: 186 - protein, 329 aa, Artificial Sequence
  IgG-pI-Iso3-434S  (Figure 92G)
ASTKGPSVFPLAPSSKSTSESTAALGCLVKDYFPEPVTVSWNSGALTSGVHTFPAVLQSSGLYSLSSVVTVPSSNFGTQTYTCNVDHKPSNTKVDKTVEPKSCDTTHTCPPCPAPELLGGPSVFLFPPKPKDTLMISRTPEVTCVVVDVSHEDPEVQFNWYVDGVEVHNAKTKPREEQFNSTFRVVSVLTVVHQDWLNGKEYKCKVSNKALPAPIEKTISKTKGQPREPQVYTLPPSQEEMTKNQVSLTCLVKGFYPSDIAVEWESSGQPENNYNTTPPMLDSDGSFFLYSKLTVDKSRWQEGNVFSCSVMHEALHSHYTQKSLSLSPG

SEQ ID NO: 187 - protein, 325 aa, Artificial Sequence; identical to SEQ ID NO: 19
  IgG-pI-Iso2  (Figure 92G)

SEQ ID NO: 188 - protein, 329 aa, Artificial Sequence; identical to SEQ ID NO: 184
  IgG-pI-Iso3  (Figure 92G)

SEQ ID NO: 189 - protein, 325 aa, Artificial Sequence; identical to SEQ ID NO: 185
  IgG-pI-Iso2-434S  (Figure 92G)

SEQ ID NO: 190 - protein, 329 aa, Artificial Sequence; identical to SEQ ID NO: 186
  IgG-pI-Iso3-434S  (Figure 92H)

SEQ ID NO: 191 - protein, 329 aa, Artificial Sequence
  IgG-pI-Iso3-434S (B)  (Figure 92H)
ASTKGPSVFPLAPSSKSTSESTAALGCLVKDYFPEPVTVSWNSGALTSGVHTFPAVLQSSGLYSLSSVVTVPSSNFGTQTYTCNVDHKPSNTKVDKTVEPKSCDKTHTCPPCPAPELLGGPSVFLFPPKPKDTLMISRTPEVTCVVVDVSHEDPEVQFNWYVDGVEVHNAKTKPREEQFNSTFRVVSVLTVVHQDWLNGKEYKCKVSNKALPAPIEKTISKTKGQPREPQVYTLPPSQEEMTKNQVSLTCLVKGFYPSDIAVEWESSGQPENNYNTTPPMLDSDGSFFLYSKLTVDKSRWQEGNVFSCSVMHEALHNHYTQKSLSLSPG

SEQ ID NO: 192 - protein, 329 aa, Artificial Sequence
  IgG-pI-Iso3-434S (C)  (Figure 92H)
ASTKGPSVFPLAPSSKSTSESTAALGCLVKDYFPEPVTVSWNSGALTSGVHTFPAVLQSSGLYSLSSVVTVPSSNFGTQTYTCNVDHKPSNTKVDKTVEPKSCDTTHTCPPCPAPELLGGPSVFLFPPKPKDTLMISRTPEVTCVVVDVSHEDPEVKFNWYVDGVEVHNAKTKPREEQFNSTFRVVSVLTVVHQDWLNGKEYKCKVSNKALPAPIEKTISKTKGQPREPQVYTLPPSQEEMTKNQVSLTCLVKGFYPSDIAVEWESSGQPENNYNTTPPMLDSDGSFFLYSKLTVDKSRWQEGNVFSCSVMHEALHNHYTQKSLSLSPG

SEQ ID NO: 193 - protein, 329 aa, Artificial Sequence
  IgG-pI-Iso3-434S (D)  (Figure 92H)
ASTKGPSVFPLAPSSKSTSESTAALGCLVKDYFPEPVTVSWNSGALTSGVHTFPAVLQSSGLYSLSSVVTVPSSNFGTQTYTCNVDHKPSNTKVDKTVEPKSCDTTHTCPPCPAPELLGGPSVFLFPPKPKDTLMISRTPEVTCVVVDVSHEDPEVQFNWYVDGVEVHNAKTKPREEQYNSTFRVVSVLTVVHQDWLNGKEYKCKVSNKALPAPIEKTISKTKGQPREPQVYTLPPSQEEMTKNQVSLTCLVKGFYPSDIAVEWESSGQPENNYNTTPPMLDSDGSFFLYSKLTVDKSRWQEGNVFSCSVMHEALHNHYTQKSLSLSPG

SEQ ID NO: 194 - protein, 329 aa, Artificial Sequence
  IgG-pI-Iso3-434S (E)  (Figure 92H)
ASTKGPSVFPLAPSSKSTSESTAALGCLVKDYFPEPVTVSWNSGALTSGVHTFPAVLQSSGLYSLSSVVTVPSSNFGTQTYTCNVDHKPSNTKVDKTVEPKSCDTTHTCPPCPAPELLGGPSVFLFPPKPKDTLMISRTPEVTCVVVDVSHEDPEVQFNWYVDGVEVHNAKTKPREEQFNSTYRVVSVLTVVHQDWLNGKEYKCKVSNKALPAPIEKTISKTKGQPREPQVYTLPPSQEEMTKNQVSLTCLVKGFYPSDIAVEWESSGQPENNYNTTPPMLDSDGSFFLYSKLTVDKSRWQEGNVFSCSVMHEALHNHYTQKSLSLSPG

SEQ ID NO: 195 - protein, 329 aa, Artificial Sequence
  IgG-pI-Iso3-434S (F)  (Figure 92H)
ASTKGPSVFPLAPSSKSTSESTAALGCLVKDYFPEPVTVSWNSGALTSGVHTFPAVLQSSGLYSLSSVVTVPSSNFGTQTYTCNVDHKPSNTKVDKTVEPKSCDTTHTCPPCPAPELLGGPSVFLFPPKPKDTLMISRTPEVTCVVVDVSHEDPEVQFNWYVDGVEVHNAKTKPREEQFNSTFRVVSVLTVLHQDWLNGKEYKCKVSNKALPAPIEKTISKTKGQPREPQVYTLPPSQEEMTKNQVSLTCLVKGFYPSDIAVEWESSGQPENNYNTTPPMLDSDGSFFLYSKLTVDKSRWQEGNVFSCSVMHEALHNHYTQKSLSLSPG

SEQ ID NO: 196 - protein, 329 aa, Artificial Sequence
  IgG-pI-Iso3-434S (G)  (Figure 92I)
ASTKGPSVFPLAPSSKSTSESTAALGCLVKDYFPEPVTVSWNSGALTSGVHTFPAVLQSSGLYSLSSVVTVPSSNFGTQTYTCNVDHKPSNTKVDKTVEPKSCDTTHTCPPCPAPELLGGPSVFLFPPKPKDTLMISRTPEVTCVVVDVSHEDPEVQFNWYVDGVEVHNAKTKPREEQFNSTFRVVSVLTVVHQDWLNGKEYKCKVSNKALPAPIEKTISKAKGQPREPQVYTLPPSQEEMTKNQVSLTCLVKGFYPSDIAVEWESSGQPENNYNTTPPMLDSDGSFFLYSKLTVDKSRWQEGNVFSCSVMHEALHNHYTQKSLSLSPG

SEQ ID NO: 197 - protein, 329 aa, Artificial Sequence
  IgG-pI-Iso3-434S (H)  (Figure 92I)
ASTKGPSVFPLAPSSKSTSESTAALGCLVKDYFPEPVTVSWNSGALTSGVHTFPAVLQSSGLYSLSSVVTVPSSNFGTQTYTCNVDHKPSNTKVDKTVEPKSCDTTHTCPPCPAPELLGGPSVFLFPPKPKDTLMISRTPEVTCVVVDVSHEDPEVQFNWYVDGVEVHNAKTKPREEQFNSTFRVVSVLTVVHQDWLNGKEYKCKVSNKALPAPIEKTISKTKGQPREPQVYTLPPSREEMTKNQVSLTCLVKGFYPSDIAVEWESSGQPENNYNTTPPMLDSDGSFFLYSKLTVDKSRWQEGNVFSCSVMHEALHNHYTQKSLSLSPG

SEQ ID NO: 198 - protein, 329 aa, Artificial Sequence
  IgG-pI-Iso3-434S (I)  (Figure 92I)
ASTKGPSVFPLAPSSKSTSESTAALGCLVKDYFPEPVTVSWNSGALTSGVHTFPAVLQSSGLYSLSSVVTVPSSNFGTQTYTCNVDHKPSNTKVDKTVEPKSCDTTHTCPPCPAPELLGGPSVFLFPPKPKDTLMISRTPEVTCVVVDVSHEDPEVQFNWYVDGVEVHNAKTKPREEQFNSTFRVVSVLTVVHQDWLNGKEYKCKVSNKALPAPIEKTISKTKGQPREPQVYTLPPSQEEMTKNQVSLTCLVKGFYPSDIAVEWESNGQPENNYNTTPPMLDSDGSFFLYSKLTVDKSRWQEGNVFSCSVMHEALHNHYTQKSLSLSPG

SEQ ID NO: 199 - protein, 329 aa, Artificial Sequence
  IgG-pI-Iso3-434S (J)  (Figure 92I)
ASTKGPSVFPLAPSSKSTSESTAALGCLVKDYFPEPVTVSWNSGALTSGVHTFPAVLQSSGLYSLSSVVTVPSSNFGTQTYTCNVDHKPSNTKVDKTVEPKSCDTTHTCPPCPAPELLGGPSVFLFPPKPKDTLMISRTPEVTCVVVDVSHEDPEVQFNWYVDGVEVHNAKTKPREEQFNSTFRVVSVLTVVHQDWLNGKEYKCKVSNKALPAPIEKTISKTKGQPREPQVYTLPPSQEEMTKNQVSLTCLVKGFYPSDIAVEWESSGQPENNYKTTPPMLDSDGSFFLYSKLTVDKSRWQEGNVFSCSVMHEALHNHYTQKSLSLSPG

SEQ ID NO: 200 - protein, 329 aa, Artificial Sequence
  IgG-pI-Iso3-434S (K)  (Figure 92I)
ASTKGPSVFPLAPSSKSTSESTAALGCLVKDYFPEPVTVSWNSGALTSGVHTFPAVLQSSGLYSLSSVVTVPSSNFGTQTYTCNVDHKPSNTKVDKTVEPKSCDTTHTCPPCPAPELLGGPSVFLFPPKPKDTLMISRTPEVTCVVVDVSHEDPEVQFNWYVDGVEVHNAKTKPREEQFNSTFRVVSVLTVVHQDWLNGKEYKCKVSNKALPAPIEKTISKTKGQPREPQVYTLPPSQEEMTKNQVSLTCLVKGFYPSDIAVEWESSGQPENNYNTTPPVLDSDGSFFLYSKLTVDKSRWQEGNVFSCSVMHEALHNHYTQKSLSLSPG

SEQ ID NO: 201 - protein, 329 aa, Artificial Sequence
  IgG-pI-Iso3-434S (L)  (Figure 92I)
ASTKGPSVFPLAPSSKSTSESTAALGCLVKDYFPEPVTVSWNSGALTSGVHTFPAVLQSSGLYSLSSVVTVPSSNFGTQTYTCNVDHKPSNTKVDKTVEPKSCDTTHTCPPCPAPELLGGPSVFLFPPKPKDTLMISRTPEVTCVVVDVSHEDPEVQFNWYVDGVEVHNAKTKPREEQFNSTFRVVSVLTVVHQDWLNGKEYKCKVSNKALPAPIEKTISKTKGQPREPQVYTLPPSQEEMTKNQVSLTCLVKGFYPSDIAVEWESSGQPENNYNTTPPMLDSDGSFFLYSKLTVDKSRWQQGNVFSCSVMHEALHNHYTQKSLSLSPG

SEQ ID NO: 202 - protein, 329 aa, Artificial Sequence
  IgG-pI-Iso3-434S (M)  (Figure 92J)
ASTKGPSVFPLAPSSKSTSESTAALGCLVKDYFPEPVTVSWNSGALTSGVHTFPAVLQSSGLYSLSSVVTVPSSNFGTQTYTCNVDHKPSNTKVDKTVEPKSCDTTHTCPPCPAPELLGGPSVFLFPPKPKDTLMISRTPEVTCVVVDVSHEDPEVQFNWYVDGVEVHNAKTKPREEQYNSTYRVVSVLTVVHQDWLNGKEYKCKVSNKALPAPIEKTISKTKGQPREPQVYTLPPSQEEMTKNQVSLTCLVKGFYPSDIAVEWESSGQPENNYNTTPPMLDSDGSFFLYSKLTVDKSRWQEGNVFSCSVMHEALHNHYTQKSLSLSPG

SEQ ID NO: 203 - protein, 329 aa, Artificial Sequence
  IgG-pI-Iso3-434S (N)  (Figure 92J)
ASTKGPSVFPLAPSSKSTSESTAALGCLVKDYFPEPVTVSWNSGALTSGVHTFPAVLQSSGLYSLSSVVTVPSSNFGTQTYTCNVDHKPSNTKVDKTVEPKSCDTTHTCPPCPAPELLGGPSVFLFPPKPKDTLMISRTPEVTCVVVDVSHEDPEVQFNWYVDGVEVHNAKTKPREEQFNSTFRVVSVLTVVHQDWLNGKEYKCKVSNKALPAPIEKTISKTKGQPREPQVYTLPPSQEEMTKNQVSLTCLVKGFYPSDIAVEWESNGQPENNYKTTPPVLDSDGSFFLYSKLTVDKSRWQEGNVFSCSVMHEALHNHYTQKSLSLSPG

SEQ ID NO: 204 - protein, 329 aa, Artificial Sequence
  IgG-pI-Iso3-434S (O)  (Figure 92J)
ASTKGPSVFPLAPSSKSTSGSTAALGCLVKDYFPEPVTVSWNSGALTSGVHTFPAVLQSSGLYSLSSVVTVPSSNFGTQTYTCNVDHKPSNTKVDKTVEPKSCDTTHTCPPCPAPELLGGPSVFLFPPKPKDTLMISRTPEVTCVVVDVSHEDPEVQFNWYVDGVEVHNAKTKPREEQFNSTFRVVSVLTVVHQDWLNGKEYKCKVSNKALPAPIEKTISKTKGQPREPQVYTLPPSQEEMTKNQVSLTCLVKGFYPSDIAVEWESSGQPENNYNTTPPMLDSDGSFFLYSKLTVDKSRWQEGNVFSCSVMHEALHNHYTQKSLSLSPG

SEQ ID NO: 205 - protein, 329 aa, Artificial Sequence
  IgG-pI-Iso3-434S (P)  (Figure 92J)
ASTKGPSVFPLAPSSKSTSEGTAALGCLVKDYFPEPVTVSWNSGALTSGVHTFPAVLQSSGLYSLSSVVTVPSSNFGTQTYTCNVDHKPSNTKVDKTVEPKSCDTTHTCPPCPAPELLGGPSVFLFPPKPKDTLMISRTPEVTCVVVDVSHEDPEVQFNWYVDGVEVHNAKTKPREEQFNSTFRVVSVLTVVHQDWLNGKEYKCKVSNKALPAPIEKTISKTKGQPREPQVYTLPPSQEEMTKNQVSLTCLVKGFYPSDIAVEWESSGQPENNYNTTPPMLDSDGSFFLYSKLTVDKSRWQEGNVFSCSVMHEALHNHYTQKSLSLSPG

SEQ ID NO: 206 - protein, 329 aa, Artificial Sequence
  IgG-pI-Iso3-434S  (Figure 92J)
ASTKGPSVFPLAPSSKSTSESTAALGCLVKDYFPEPVTVSWNSGALTSGVHTFPAVLQSSGLYSLSSVVTVPSSSFGTQTYTCNVDHKPSNTKVDKTVEPKSCDTTHTCPPCPAPELLGGPSVFLFPPKPKDTLMISRTPEVTCVVVDVSHEDPEVQFNWYVDGVEVHNAKTKPREEQFNSTFRVVSVLTVVHQDWLNGKEYKCKVSNKALPAPIEKTISKTKGQPREPQVYTLPPSQEEMTKNQVSLTCLVKGFYPSDIAVEWESSGQPENNYNTTPPMLDSDGSFFLYSKLTVDKSRWQEGNVFSCSVMHEALHNHYTQKSLSLSPG

SEQ ID NO: 207 - protein, 329 aa, Artificial Sequence
  IgG-pI-Iso3-434S (R)  (Figure 92J)
ASTKGPSVFPLAPSSKSTSESTAALGCLVKDYFPEPVTVSWNSGALTSGVHTFPAVLQSSGLYSLSSVVTVPSSNLGTQTYTCNVDHKPSNTKVDKTVEPKSCDTTHTCPPCPAPELLGGPSVFLFPPKPKDTLMISRTPEVTCVVVDVSHEDPEVQFNWYVDGVEVHNAKTKPREEQFNSTFRVVSVLTVVHQDWLNGKEYKCKVSNKALPAPIEKTISKTKGQPREPQVYTLPPSQEEMTKNQVSLTCLVKGFYPSDIAVEWESSGQPENNYNTTPPMLDSDGSFFLYSKLTVDKSRWQEGNVFSCSVMHEALHNHYTQKSLSLSPG

SEQ ID NO: 208 - protein, 329 aa, Artificial Sequence
  IgG-pI-Iso3-434S (S)  (Figure 92K)
ASTKGPSVFPLAPSSKSTSESTAALGCLVKDYFPEPVTVSWNSGALTSGVHTFPAVLQSSGLYSLSSVVTVPSSNFGTQTYICNVDHKPSNTKVDKTVEPKSCDTTHTCPPCPAPELLGGPSVFLFPPKPKDTLMISRTPEVTCVVVDVSHEDPEVQFNWYVDGVEVHNAKTKPREEQFNSTFRVVSVLTVVHQDWLNGKEYKCKVSNKALPAPIEKTISKTKGQPREPQVYTLPPSQEEMTKNQVSLTCLVKGFYPSDIAVEWESSGQPENNYNTTPPMLDSDGSFFLYSKLTVDKSRWQEGNVFSCSVMHEALHNHYTQKSLSLSPG

SEQ ID NO: 209 - protein, 329 aa, Artificial Sequence
  IgG-pI-Iso3-434S (T)  (Figure 92K)
ASTKGPSVFPLAPSSKSTSESTAALGCLVKDYFPEPVTVSWNSGALTSGVHTFPAVLQSSGLYSLSSVVTVPSSNFGTQTYTCNVNHKPSNTKVDKTVEPKSCDTTHTCPPCPAPELLGGPSVFLFPPKPKDTLMISRTPEVTCVVVDVSHEDPEVQFNWYVDGVEVHNAKTKPREEQFNSTFRVVSVLTVVHQDWLNGKEYKCKVSNKALPAPIEKTISKTKGQPREPQVYTLPPSQEEMTKNQVSLTCLVKGFYPSDIAVEWESSGQPENNYNTTPPMLDSDGSFFLYSKLTVDKSRWQEGNVFSCSVMHEALHNHYTQKSLSLSPG

SEQ ID NO: 210 - protein, 329 aa, Artificial Sequence
  IgG-pI-Iso3-434S (U)  (Figure 92K)
ASTKGPSVFPLAPSSKSTSESTAALGCLVKDYFPEPVTVSWNSGALTSGVHTFPAVLQSSGLYSLSSVVTVPSSNFGTQTYTCNVDHKPSNTKVDKKVEPKSCDTTHTCPPCPAPELLGGPSVFLFPPKPKDTLMISRTPEVTCVVVDVSHEDPEVQFNWYVDGVEVHNAKTKPREEQFNSTFRVVSVLTVVHQDWLNGKEYKCKVSNKALPAPIEKTISKTKGQPREPQVYTLPPSQEEMTKNQVSLTCLVKGFYPSDIAVEWESSGQPENNYNTTPPMLDSDGSFFLYSKLTVDKSRWQEGNVFSCSVMHEALHNHYTQKSLSLSPG

SEQ ID NO: 211 - protein, 329 aa, Artificial Sequence
  IgG-pI-Iso3-434S (V)  (Figure 92K)
ASTKGPSVFPLAPSSKSTSGGTAALGCLVKDYFPEPVTVSWNSGALTSGVHTFPAVLQSSGLYSLSSVVTVPSSNFGTQTYTCNVDHKPSNTKVDKTVEPKSCDTTHTCPPCPAPELLGGPSVFLFPPKPKDTLMISRTPEVTCVVVDVSHEDPEVQFNWYVDGVEVHNAKTKPREEQFNSTFRVVSVLTVVHQDWLNGKEYKCKVSNKALPAPIEKTISKTKGQPREPQVYTLPPSQEEMTKNQVSLTCLVKGFYPSDIAVEWESSGQPENNYNTTPPMLDSDGSFFLYSKLTVDKSRWQEGNVFSCSVMHEALHNHYTQKSLSLSPG

SEQ ID NO: 212 - protein, 329 aa, Artificial Sequence
  IgG-pI-Iso3-SL  (Figure 92K)
ASTKGPSVFPLAPSSKSTSESTAALGCLVKDYFPEPVTVSWNSGALTSGVHTFPAVLQSSGLYSLSSVVTVPSSSLGTQTYTCNVDHKPSNTKVDKTVEPKSCDTTHTCPPCPAPELLGGPSVFLFPPKPKDTLMISRTPEVTCVVVDVSHEDPEVQFNWYVDGVEVHNAKTKPREEQFNSTFRVVSVLTVVHQDWLNGKEYKCKVSNKALPAPIEKTISKTKGQPREPQVYTLPPSQEEMTKNQVSLTCLVKGFYPSDIAVEWESSGQPENNYNTTPPMLDSDGSFFLYSKLTVDKSRWQEGNVFSCSVMHEALHNHYTQKSLSLSPG

SEQ ID NO: 213 - protein, 329 aa, Artificial Sequence
  IgG-pI-Iso3-SL (B)  (Figure 92K)
ASTKGPSVFPLAPSSKSTSESTAALGCLVKDYFPEPVTVSWNSGALTSGVHTFPAVLQSSGLYSLSSVVTVPSSNFGTQTYICNVNHKPSNTKVDKTVEPKSCDTTHTCPPCPAPELLGGPSVFLFPPKPKDTLMISRTPEVTCVVVDVSHEDPEVQFNWYVDGVEVHNAKTKPREEQFNSTFRVVSVLTVVHQDWLNGKEYKCKVSNKALPAPIEKTISKTKGQPREPQVYTLPPSQEEMTKNQVSLTCLVKGFYPSDIAVEWESSGQPENNYNTTPPMLDSDGSFFLYSKLTVDKSRWQEGNVFSCSVMHEALHNHYTQKSLSLSPG

SEQ ID NO: 214 - protein, 329 aa, Artificial Sequence
  IgG-pI-Iso3-SL (C)  (Figure 92L)
ASTKGPSVFPLAPSSKSTSESTAALGCLVKDYFPEPVTVSWNSGALTSGVHTFPAVLQSSGLYSLSSVVTVPSSNFGTQTYTCNVDHKPSNTKVDKKVEPKSCDKTHTCPPCPAPELLGGPSVFLFPPKPKDTLMISRTPEVTCVVVDVSHEDPEVQFNWYVDGVEVHNAKTKPREEQFNSTFRVVSVLTVVHQDWLNGKEYKCKVSNKALPAPIEKTISKTKGQPREPQVYTLPPSQEEMTKNQVSLTCLVKGFYPSDIAVEWESSGQPENNYNTTPPMLDSDGSFFLYSKLTVDKSRWQEGNVFSCSVMHEALHNHYTQKSLSLSPG

SEQ ID NO: 215 - protein, 329 aa, Artificial Sequence
  IgG-pI-Iso3-SL (D)  (Figure 92L)
ASTKGPSVFPLAPSSKSTSEGTAALGCLVKDYFPEPVTVSWNSGALTSGVHTFPAVLQSSGLYSLSSVVTVPSSSLGTQTYTCNVDHKPSNTKVDKTVEPKSCDTTHTCPPCPAPELLGGPSVFLFPPKPKDTLMISRTPEVTCVVVDVSHEDPEVQFNWYVDGVEVHNAKTKPREEQFNSTFRVVSVLTVVHQDWLNGKEYKCKVSNKALPAPIEKTISKTKGQPREPQVYTLPPSQEEMTKNQVSLTCLVKGFYPSDIAVEWESSGQPENNYNTTPPMLDSDGSFFLYSKLTVDKSRWQEGNVFSCSVMHEALHNHYTQKSLSLSPG

SEQ ID NO: 216 - protein, 329 aa, Artificial Sequence
  IgG-pI-Iso3-SL (E)  (Figure 92L)
ASTKGPSVFPLAPSSKSTSGGTAALGCLVKDYFPEPVTVSWNSGALTSGVHTFPAVLQSSGLYSLSSVVTVPSSSLGTQTYTCNVDHKPSNTKVDKTVEPKSCDTTHTCPPCPAPELLGGPSVFLFPPKPKDTLMISRTPEVTCVVVDVSHEDPEVQFNWYVDGVEVHNAKTKPREEQFNSTFRVVSVLTVVHQDWLNGKEYKCKVSNKALPAPIEKTISKTKGQPREPQVYTLPPSQEEMTKNQVSLTCLVKGFYPSDIAVEWESSGQPENNYNTTPPMLDSDGSFFLYSKLTVDKSRWQEGNVFSCSVMHEALHNHYTQKSLSLSPG

SEQ ID NO: 217 - protein, 329 aa, Artificial Sequence; identical to SEQ ID NO: 184
  IgG-pI-Iso3  (Figure 92L)

SEQ ID NO: 218 - protein, 329 aa, Artificial Sequence; identical to SEQ ID NO: 184
  IgG-pI-Iso3 (B)  (Figure 92L)

SEQ ID NO: 219 - protein, 329 aa, Artificial Sequence; identical to SEQ ID NO: 184
  IgG-pI-Iso3 (C)  (Figure 92L)

SEQ ID NO: 220 - protein, 329 aa, Artificial Sequence; identical to SEQ ID NO: 184
  IgG-pI-Iso3 (D)  (Figure 92M)

SEQ ID NO: 221 - protein, 327 aa, Artificial Sequence
  IgG-pI-Iso3 (E)  (Figure 92M)
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 222 - protein, 329 aa, Artificial Sequence
  IgG-pI-Iso3-charges-only  (Figure 92M)
ASTKGPSVFPLAPSSKSTSEGTAALGCLVKDYFPEPVTVSWNSGALTSGVHTFPAVLQSSGLYSLSSVVTVPSSSLGTQTYICNVDHKPSNTKVDKTVEPKSCDTTHTCPPCPAPELLGGPSVFLFPPKPKDTLMISRTPEVTCVVVDVSHEDPEVQFNWYVDGVEVHNAKTKPREEQYNSTYRVVSVLTVLHQDWLNGKEYKCKVSNKALPAPIEKTISKAKGQPREPQVYTLPPSQEEMTKNQVSLTCLVKGFYPSDIAVEWESNGQPENNYNTTPPVLDSDGSFFLYSKLTVDKSRWQEGNVFSCSVMHEALHNHYTQKSLSLSPG

SEQ ID NO: 223 - protein, 325 aa, Artificial Sequence
  IgG-pI-Iso2-charges-only  (Figure 92M)
ASTKGPSVFPLAPSSKSTSEGTAALGCLVKDYFPEPVTVSWNSGALTSGVHTFPAVLQSSGLYSLSSVVTVPSSSLGTQTYICNVDHKPSNTKVDKTVEPKSCVECPPCPAPPVAGPSVFLFPPKPKDTLMISRTPEVTCVVVDVSHEDPEVQFNWYVDGVEVHNAKTKPREEQYNSTYRVVSVLTVLHQDWLNGKEYKCKVSNKGLPAPIEKTISKAKGQPREPQVYTLPPSQEEMTKNQVSLTCLVKGFYPSDIAVEWESNGQPENNYNTTPPVLDSDGSFFLYSKLTVDKSRWQEGNVFSCSVMHEALHNHYTQKSLSLSPG

SEQ ID NO: 224 - protein, 330 aa, Artificial Sequence
  IgG-pI-Iso2-charges-only  (Figure 92M)
ASTKGPSVFPLAPSSRSTSESTAALGCLVKDYFPEPVTVSWNSGALTSGVHTFPAVLQSSGLYSLSSVVTVPSSNFGTQTYTCNVDHKPSNTKVDKTVERKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 225 - protein, 329 aa, Artificial Sequence
  IgG-pI-Iso3-SL-434S  (Figure 92M)
ASTKGPSVFPLAPSSKSTSESTAALGCLVKDYFPEPVTVSWNSGALTSGVHTFPAVLQSSGLYSLSSVVTVPSSSLGTQTYTCNVDHKPSNTKVDKTVEPKSCDTTHTCPPCPAPELLGGPSVFLFPPKPKDTLMISRTPEVTCVVVDVSHEDPEVQFNWYVDGVEVHNAKTKPREEQFNSTFRVVSVLTVVHQDWLNGKEYKCKVSNKALPAPIEKTISKTKGQPREPQVYTLPPSQEEMTKNQVSLTCLVKGFYPSDIAVEWESSGQPENNYNTTPPMLDSDGSFFLYSKLTVDKSRWQEGNVFSCSVMHEALHSHYTQKSLSLSPG

SEQ ID NO: 226 - protein, 329 aa, Artificial Sequence
  IgG-pI-Iso3-SL-428L/434S  (Figure 92N)
ASTKGPSVFPLAPSSKSTSESTAALGCLVKDYFPEPVTVSWNSGALTSGVHTFPAVLQSSGLYSLSSVVTVPSSSLGTQTYTCNVDHKPSNTKVDKTVEPKSCDTTHTCPPCPAPELLGGPSVFLFPPKPKDTLMISRTPEVTCVVVDVSHEDPEVQFNWYVDGVEVHNAKTKPREEQFNSTFRVVSVLTVVHQDWLNGKEYKCKVSNKALPAPIEKTISKTKGQPREPQVYTLPPSQEEMTKNQVSLTCLVKGFYPSDIAVEWESSGQPENNYNTTPPMLDSDGSFFLYSKLTVDKSRWQEGNVFSCSVLHEALHSHYTQKSLSLSPG

SEQ ID NO: 227 - protein, 329 aa, Artificial Sequence
  IgG-pI-Iso3-SL-428L/434S (B)  (Figure 92N)
ASTKGPSVFPLAPSSKSTSEGTAALGCLVKDYFPEPVTVSWNSGALTSGVHTFPAVLQSSGLYSLSSVVTVPSSSLGTQTYTCNVDHKPSNTKVDKTVEPKSCDTTHTCPPCPAPELLGGPSVFLFPPKPKDTLMISRTPEVTCVVVDVSHEDPEVQFNWYVDGVEVHNAKTKPREEQFNSTFRVVSVLTVVHQDWLNGKEYKCKVSNKALPAPIEKTISKTKGQPREPQVYTLPPSQEEMTKNQVSLTCLVKGFYPSDIAVEWESSGQPENNYNTTPPMLDSDGSFFLYSKLTVDKSRWQEGNVFSCSVMHEALHSHYTQKSLSLSPG

SEQ ID NO: 228 - protein, 329 aa, Artificial Sequence
  IgG-pI-Iso3-SL-428L/434S (C)  (Figure 92N)
ASTKGPSVFPLAPSSKSTSGGTAALGCLVKDYFPEPVTVSWNSGALTSGVHTFPAVLQSSGLYSLSSVVTVPSSSLGTQTYTCNVDHKPSNTKVDKTVEPKSCDTTHTCPPCPAPELLGGPSVFLFPPKPKDTLMISRTPEVTCVVVDVSHEDPEVQFNWYVDGVEVHNAKTKPREEQFNSTFRVVSVLTVVHQDWLNGKEYKCKVSNKALPAPIEKTISKTKGQPREPQVYTLPPSQEEMTKNQVSLTCLVKGFYPSDIAVEWESSGQPENNYNTTPPMLDSDGSFFLYSKLTVDKSRWQEGNVFSCSVMHEALHSHYTQKSLSLSPG

SEQ ID NO: 229 - protein, 325 aa, Artificial Sequence; identical to SEQ ID NO: 20
  IgG-pI-Iso2-SL  (Figure 92N)

SEQ ID NO: 230 - protein, 325 aa, Artificial Sequence; identical to SEQ ID NO: 61
  IgG-pI-Iso2-SL-434S  (Figure 92N)

SEQ ID NO: 231 - protein, 329 aa, Artificial Sequence
  IgG-pI-Iso3-charges-only-434S  (Figure 92N)
ASTKGPSVFPLAPSSKSTSEGTAALGCLVKDYFPEPVTVSWNSGALTSGVHTFPAVLQSSGLYSLSSVVTVPSSSLGTQTYICNVDHKPSNTKVDKTVEPKSCDTTHTCPPCPAPELLGGPSVFLFPPKPKDTLMISRTPEVTCVVVDVSHEDPEVQFNWYVDGVEVHNAKTKPREEQYNSTYRVVSVLTVLHQDWLNGKEYKCKVSNKALPAPIEKTISKAKGQPREPQVYTLPPSQEEMTKNQVSLTCLVKGFYPSDIAVEWESNGQPENNYNTTPPVLDSDGSFFLYSKLTVDKSRWQEGNVFSCSVMHEALHSHYTQKSLSLSPG

SEQ ID NO: 232 - protein, 325 aa, Artificial Sequence
  IgG-pI-Iso2-charges-only-434S  (Figure 92O)
ASTKGPSVFPLAPSSKSTSEGTAALGCLVKDYFPEPVTVSWNSGALTSGVHTFPAVLQSSGLYSLSSVVTVPSSSLGTQTYICNVDHKPSNTKVDKTVEPKSCVECPPCPAPPVAGPSVFLFPPKPKDTLMISRTPEVTCVVVDVSHEDPEVQFNWYVDGVEVHNAKTKPREEQYNSTYRVVSVLTVLHQDWLNGKEYKCKVSNKGLPAPIEKTISKAKGQPREPQVYTLPPSQEEMTKNQVSLTCLVKGFYPSDIAVEWESNGQPENNYNTTPPVLDSDGSFFLYSKLTVDKSRWQEGNVFSCSVMHEALHSHYTQKSLSLSPG

SEQ ID NO: 233 - protein, 327 aa, Artificial Sequence
  IgG-pI-Iso2-charges-only-434S (B)  (Figure 92O)
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHSHYTQKSLSLSPGK

SEQ ID NO: 234 - protein, 330 aa, Artificial Sequence
  IgG-pI-Iso2-charges-only-434S (C)  (Figure 92O)
ASTKGPSVFPLAPSSRSTSESTAALGCLVKDYFPEPVTVSWNSGALTSGVHTFPAVLQSSGLYSLSSVVTVPSSNFGTQTYTCNVDHKPSNTKVDKTVERKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHSHYTQKSLSLSPGK

SEQ ID NO: 235 - protein, 329 aa, Artificial Sequence
  IgG1_pI(7)-434S  (Figure 92O)
ASTKGPSVFPLAPSSESTSGGTAALGCLVKDYFPEPVTVSWNSGALTSGVHTFPAVLQSSGLYSLSSVVTVPSSSLGTQTYICNVNHEPSNTEVDKKVEPKSCDKTHTCPPCPAPELLGGPSVFLFPPKPKDTLMISRTPEVTCVVVDVSHEDPEVEFNWYVDGVEVHNAKTKPREEQYNSTYRVVSVLTVLHQDWLNGKEYKCKVSNKALPAPIEKTISKAKGQPREPQVYTLPPSEEEMTKNQVSLTCLVKGFYPSDIAVEWESNGQPENNYETTPPVLDSDGSFFLYSKLTVDKSRWQQGNVFSCSVMHEALHSHYTQKSLSLSPG

SEQ ID NO: 236 - protein, 328 aa, Artificial Sequence
  IgG1/2_pI(7)-434S  (Figure 92O)
ASTKGPSVFPLAPSSESTSGGTAALGCLVKDYFPEPVTVSWNSGALTSGVHTFPAVLQSSGLYSLSSVVTVPSSSLGTQTYICNVNHEPSNTEVDKKVEPKSCDKTHTCPPCPAPPVAGPSVFLFPPKPKDTLMISRTPEVTCVVVDVSHEDPEVEFNWYVDGVEVHNAKTKPREEQFNSTFRVVSVLTVVHQDWLNGKEYKCKVSNKGLPAPIEKTISKTKGQPREPQVYTLPPSEEEMTKNQVSLTCLVKGFYPSDIAVEWESNGQPENNYETTPPMLDSDGSFFLYSKLTVDKSRWQQGNVFSCSVMHEALHSHYTQKSLSLSPG

SEQ ID NO: 237 - protein, 325 aa, Artificial Sequence
  IgG1/2_pI(7)-434S (B)  (Figure 92O)
ASTKGPSVFPLAPSSKSTSEGTAALGCLVKDYFPEPVTVSWNSGALTSGVHTFPAVLQSSGLYSLSSVVTVPSSSLGTQTYICNVDHKPSNTKVDKTVEPKSCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSQEEMTKNQVSLTCLVKGFYPSDIAVEWESNGQPENNYNTTPPMLDSDGSFFLYSKLTVDKSRWQEGNVFSCSVMHEALHNHYTQKSLSLSPG

SEQ ID NO: 238 - protein, 329 aa, Artificial Sequence; identical to SEQ ID NO: 212
  IgG-pI-Iso3-SL  (Figure 92P)

SEQ ID NO: 239 - protein, 329 aa, Artificial Sequence; identical to SEQ ID NO: 212
  IgG-pI-Iso3-SL (B)  (Figure 92P)

SEQ ID NO: 240 - protein, 329 aa, Artificial Sequence; identical to SEQ ID NO: 212
  IgG-pI-Iso3-SL (C)  (Figure 92P)

SEQ ID NO: 241 - protein, 329 aa, Artificial Sequence; identical to SEQ ID NO: 225
  IgG-pI-Iso3-SL-434S  (Figure 92P)

SEQ ID NO: 242 - protein, 329 aa, Artificial Sequence; identical to SEQ ID NO: 225
  IgG-pI-Iso3-SL-434S (B)  (Figure 92P)

SEQ ID NO: 243 - protein, 329 aa, Artificial Sequence; identical to SEQ ID NO: 225
  IgG-pI-Iso3-SL-434S (C)  (Figure 92P)

SEQ ID NO: 244 - protein, 329 aa, Artificial Sequence; identical to SEQ ID NO: 226
  IgG-pI-Iso3-SL-428L/434S  (Figure 92Q)

SEQ ID NO: 245 - protein, 329 aa, Artificial Sequence; identical to SEQ ID NO: 226
  IgG-pI-Iso3-SL-428L/434S (B)  (Figure 92Q)

SEQ ID NO: 246 - protein, 329 aa, Artificial Sequence; identical to SEQ ID NO: 226
  IgG-pI-Iso3-SL-428L/434S (C)  (Figure 92Q)

SEQ ID NO: 247 - protein, 329 aa, Artificial Sequence; identical to SEQ ID NO: 225
  IgG-pI-Iso3-SL-434S  (Figure 92Q)

SEQ ID NO: 248 - protein, 329 aa, Artificial Sequence; identical to SEQ ID NO: 186
  IgG-pI-Iso3-434S  (Figure 92Q)

SEQ ID NO: 249 - protein, 329 aa, Artificial Sequence; identical to SEQ ID NO: 186
  IgG-pI-Iso2-SL-434S  (Figure 92Q)

SEQ ID NO: 250 - protein, 330 aa, Artificial Sequence
  IgG-pI-CH1-v4  (Figure 92R)
AETKGPSVFPLAPSSESTSGGTAALGCLVKDYFPEPVTVSWNSGALESGVHTFPAVLQSSGLYSLSSVVTVPSSSLGTQTYICNVNHKPSDTEVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 251 - protein, 330 aa, Artificial Sequence
  IgG-pI-CH1-v25  (Figure 92R)
AETKGPSVFPLAPSSKSTSGGTAALGCLVKDYFPEPVTVSWNSGALESGVHTFPAVLQSSGLYSLSSVVTVPSSSLGTQTYICNVNHKPSDTEVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 252 - protein, 330 aa, Artificial Sequence
  IgG-pI-CH1-v42  (Figure 92R)
ASTKGPSVFPLAPSSKSTSGGTAALGCLVKDYFPEPVTVSWNSGALESGVHTFPAVLQSSGLYSLSSVVTVPSSSLGTQTYICNVNHKPSDTEVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 253 - protein, 330 aa, Artificial Sequence
  IgG-pI-CH1-v16  (Figure 92R)
ASTKGPSVFPLAPSSKSTSGGTAALGCLVKDYFPEPVTVSWNSGALTSGVHTFPAVLQSSGLYSLSSVVTVPSSSLGTQTYICNVNHKPSDTEVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 254 - protein, 329 aa, Artificial Sequence
  IgG-pI-CH1-v4-SLFFV-Iso-434S  (Figure 92R)
AETKGPSVFPLAPSSESTSGGTAALGCLVKDYFPEPVTVSWNSGALESGVHTFPAVLQSSGLYSLSSVVTVPSSSLGTQTYICNVNHKPSDTEVDKKVEPKSCDKTHTCPPCPAPELLGGPSVFLFPPKPKDTLMISRTPEVTCVVVDVSHEDPEVQFNWYVDGVEVHNAKTKPREEQFNSTFRVVSVLTVVHQDWLNGKEYKCKVSNKALPAPIEKTISKTKGQPREPQVYTLPPSQEEMTKNQVSLTCLVKGFYPSDIAVEWESSGQPENNYNTTPPMLDSDGSFFLYSKLTVDKSRWQEGNVFSCSVMHEALHSHYTQKSLSLSPG

SEQ ID NO: 255 - protein, 329 aa, Artificial Sequence
  IgG-pI-CH1-v25-SLFFV-Iso-434S  (Figure 92R)
AETKGPSVFPLAPSSKSTSGGTAALGCLVKDYFPEPVTVSWNSGALESGVHTFPAVLQSSGLYSLSSVVTVPSSSLGTQTYICNVNHKPSDTEVDKKVEPKSCDKTHTCPPCPAPELLGGPSVFLFPPKPKDTLMISRTPEVTCVVVDVSHEDPEVQFNWYVDGVEVHNAKTKPREEQFNSTFRVVSVLTVVHQDWLNGKEYKCKVSNKALPAPIEKTISKTKGQPREPQVYTLPPSQEEMTKNQVSLTCLVKGFYPSDIAVEWESSGQPENNYNTTPPMLDSDGSFFLYSKLTVDKSRWQEGNVFSCSVMHEALHSHYTQKSLSLSPG

SEQ ID NO: 256 - protein, 329 aa, Artificial Sequence
  IgG-pI-CH1-v42-SLFFV-Iso-434S  (Figure 92S)
ASTKGPSVFPLAPSSKSTSGGTAALGCLVKDYFPEPVTVSWNSGALESGVHTFPAVLQSSGLYSLSSVVTVPSSSLGTQTYICNVNHKPSDTEVDKKVEPKSCDKTHTCPPCPAPELLGGPSVFLFPPKPKDTLMISRTPEVTCVVVDVSHEDPEVQFNWYVDGVEVHNAKTKPREEQFNSTFRVVSVLTVVHQDWLNGKEYKCKVSNKALPAPIEKTISKTKGQPREPQVYTLPPSQEEMTKNQVSLTCLVKGFYPSDIAVEWESSGQPENNYNTTPPMLDSDGSFFLYSKLTVDKSRWQEGNVFSCSVMHEALHSHYTQKSLSLSPG

SEQ ID NO: 257 - protein, 329 aa, Artificial Sequence
  IgG-pI-CH1-v16-SLFFV-Iso-434S  (Figure 92S)
ASTKGPSVFPLAPSSKSTSGGTAALGCLVKDYFPEPVTVSWNSGALTSGVHTFPAVLQSSGLYSLSSVVTVPSSSLGTQTYICNVNHKPSDTEVDKKVEPKSCDKTHTCPPCPAPELLGGPSVFLFPPKPKDTLMISRTPEVTCVVVDVSHEDPEVQFNWYVDGVEVHNAKTKPREEQFNSTFRVVSVLTVVHQDWLNGKEYKCKVSNKALPAPIEKTISKTKGQPREPQVYTLPPSQEEMTKNQVSLTCLVKGFYPSDIAVEWESSGQPENNYNTTPPMLDSDGSFFLYSKLTVDKSRWQEGNVFSCSVMHEALHSHYTQKSLSLSPG

SEQ ID NO: 258 - protein, 329 aa, Artificial Sequence
  IgG-pI-CH1-v4-SL-Iso-434S  (Figure 92S)
AETKGPSVFPLAPSSESTSGGTAALGCLVKDYFPEPVTVSWNSGALESGVHTFPAVLQSSGLYSLSSVVTVPSSSLGTQTYICNVNHKPSDTEVDKKVEPKSCDKTHTCPPCPAPELLGGPSVFLFPPKPKDTLMISRTPEVTCVVVDVSHEDPEVQFNWYVDGVEVHNAKTKPREEQYNSTYRVVSVLTVLHQDWLNGKEYKCKVSNKALPAPIEKTISKTKGQPREPQVYTLPPSQEEMTKNQVSLTCLVKGFYPSDIAVEWESSGQPENNYNTTPPMLDSDGSFFLYSKLTVDKSRWQEGNVFSCSVMHEALHSHYTQKSLSLSPG

SEQ ID NO: 259 - protein, 329 aa, Artificial Sequence
  IgG-pI-CH1-v25-SL-Iso-434S  (Figure 92S)
AETKGPSVFPLAPSSKSTSGGTAALGCLVKDYFPEPVTVSWNSGALESGVHTFPAVLQSSGLYSLSSVVTVPSSSLGTQTYICNVNHKPSDTEVDKKVEPKSCDKTHTCPPCPAPELLGGPSVFLFPPKPKDTLMISRTPEVTCVVVDVSHEDPEVQFNWYVDGVEVHNAKTKPREEQYNSTYRVVSVLTVLHQDWLNGKEYKCKVSNKALPAPIEKTISKTKGQPREPQVYTLPPSQEEMTKNQVSLTCLVKGFYPSDIAVEWESSGQPENNYNTTPPMLDSDGSFFLYSKLTVDKSRWQEGNVFSCSVMHEALHSHYTQKSLSLSPG

SEQ ID NO: 260 - protein, 329 aa, Artificial Sequence
  IgG-pI-CH1-v42-SL-Iso-434S  (Figure 92S)
ASTKGPSVFPLAPSSKSTSGGTAALGCLVKDYFPEPVTVSWNSGALESGVHTFPAVLQSSGLYSLSSVVTVPSSSLGTQTYICNVNHKPSDTEVDKKVEPKSCDKTHTCPPCPAPELLGGPSVFLFPPKPKDTLMISRTPEVTCVVVDVSHEDPEVQFNWYVDGVEVHNAKTKPREEQYNSTYRVVSVLTVLHQDWLNGKEYKCKVSNKALPAPIEKTISKTKGQPREPQVYTLPPSQEEMTKNQVSLTCLVKGFYPSDIAVEWESSGQPENNYNTTPPMLDSDGSFFLYSKLTVDKSRWQEGNVFSCSVMHEALHSHYTQKSLSLSPG

SEQ ID NO: 261 - protein, 329 aa, Artificial Sequence
  IgG-pI-CH1-v16-SL-Iso-434S  (Figure 92S)
ASTKGPSVFPLAPSSKSTSGGTAALGCLVKDYFPEPVTVSWNSGALTSGVHTFPAVLQSSGLYSLSSVVTVPSSSLGTQTYICNVNHKPSDTEVDKKVEPKSCDKTHTCPPCPAPELLGGPSVFLFPPKPKDTLMISRTPEVTCVVVDVSHEDPEVQFNWYVDGVEVHNAKTKPREEQYNSTYRVVSVLTVLHQDWLNGKEYKCKVSNKALPAPIEKTISKTKGQPREPQVYTLPPSQEEMTKNQVSLTCLVKGFYPSDIAVEWESSGQPENNYNTTPPMLDSDGSFFLYSKLTVDKSRWQEGNVFSCSVMHEALHSHYTQKSLSLSPG

SEQ ID NO: 262 - protein, 329 aa, Artificial Sequence
  IgG1-pI-IF16-ISO  (Figure 92T)
ASTKGPSVFPLAPSSKSTSGGTAALGCLVKDYFPEPVTVSWNSGALESGVHTFPAVLQSSGLYSLSSVVTVPSSSLGTQTYICNVNHKPSDTEVDKKVEPKSCDKTHTCPPCPAPELLGGPSVFLFPPKPKDTLMISRTPEVTCVVVDVSHEDPEVQFNWYVDGVEVHNAKTKPREEQYNSTYRVVSVLTVLHQDWLNGKEYKCKVSNKALPAPIEKTISKAKGQPREPQVYTLPPSQEEMTKNQVSLTCLVKGFYPSDIAVEWESSGQPENNYNTTPPMLDSDGSFFLYSKLTVDKSRWQEGNVFSCSVMHEALHNHYTQKSLSLSPG

SEQ ID NO: 263 - protein, 329 aa, Artificial Sequence
  IgG1-pI-IF10-ISO  (Figure 92T)
ASTKGPSVFPLAPSSKSTSGGTAALGCLVKDYFPEPVTVSWNSGALTSGVHTFPAVLQSSGLYSLSSVVTVPSSSLGTQTYICNVNHKPSDTEVDKKVEPKSCDKTHTCPPCPAPELLGGPSVFLFPPKPKDTLMISRTPEVTCVVVDVSHEDPEVQFNWYVDGVEVHNAKTKPREEQYNSTYRVVSVLTVLHQDWLNGKEYKCKVSNKALPAPIEKTISKAKGQPREPQVYTLPPSQEEMTKNQVSLTCLVKGFYPSDIAVEWESSGQPENNYNTTPPMLDSDGSFFLYSKLTVDKSRWQEGNVFSCSVMHEALHNHYTQKSLSLSPG

SEQ ID NO: 264 - protein, 325 aa, Artificial Sequence
  IgG2-pI-IF10-ISO-N434S  (Figure 92T)
ASTKGPSVFPLAPCSRSTSESTAALGCLVKDYFPEPVTVSWNSGALTSGVHTFPAVLQSSGLYSLSSVVTVPSSNFGTQTYTCNVDHEPSDTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSQEEMTKNQVSLTCLVKGFYPSDIAVEWESSGQPENNYNTTPPMLDSDGSFFLYSKLTVDKSRWQEGNVFSCSVMHEALHSHYTQKSLSLSPG

SEQ ID NO: 265 - protein, 325 aa, Artificial Sequence
  IgG2-pI-IF16-ISO-N434S  (Figure 92T)
ASTKGPSVFPLAPCSRSTSESTAALGCLVKDYFPEPVTVSWNSGALESGVHTFPAVLQSSGLYSLSSVVTVPSSNFGTQTYTCNVDHEPSDTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSQEEMTKNQVSLTCLVKGFYPSDIAVEWESSGQPENNYNTTPPMLDSDGSFFLYSKLTVDKSRWQEGNVFSCSVMHEALHSHYTQKSLSLSPG

SEQ ID NO: 266 - protein, 329 aa, Artificial Sequence; identical to SEQ ID NO: 256
  Hybrid-pI-IF16-ISO-N434S  (Figure 92T)

SEQ ID NO: 267 - protein, 329 aa, Artificial Sequence; identical to SEQ ID NO: 257
  Hybrid-pI-IF10-ISO-N434S  (Figure 92T)

SEQ ID NO: 268 - protein, 329 aa, Artificial Sequence
  Hybrid-2-1-2-pI-IF16-ISO-N434S  (Figure 92U)
ASTKGPSVFPLAPSSRSTSESTAALGCLVKDYFPEPVTVSWNSGALESGVHTFPAVLQSSGLYSLSSVVTVPSSNFGTQTYTCNVDHEPSDTEVDKTVEPKSCDKTHTCPPCPAPELLGGPSVFLFPPKPKDTLMISRTPEVTCVVVDVSHEDPEVQFNWYVDGVEVHNAKTKPREEQFNSTFRVVSVLTVVHQDWLNGKEYKCKVSNKALPAPIEKTISKTKGQPREPQVYTLPPSQEEMTKNQVSLTCLVKGFYPSDIAVEWESSGQPENNYNTTPPMLDSDGSFFLYSKLTVDKSRWQEGNVFSCSVMHEALHSHYTQKSLSLSPG

SEQ ID NO: 269 - protein, 329 aa, Artificial Sequence
  Hybrid-2-1-2-pI-IF10-ISO-N434S   (Figure 92U)
ASTKGPSVFPLAPSSRSTSESTAALGCLVKDYFPEPVTVSWNSGALTSGVHTFPAVLQSSGLYSLSSVVTVPSSNFGTQTYTCNVDHEPSDTEVDKTVEPKSCDKTHTCPPCPAPELLGGPSVFLFPPKPKDTLMISRTPEVTCVVVDVSHEDPEVQFNWYVDGVEVHNAKTKPREEQFNSTFRVVSVLTVVHQDWLNGKEYKCKVSNKALPAPIEKTISKTKGQPREPQVYTLPPSQEEMTKNQVSLTCLVKGFYPSDIAVEWESSGQPENNYNTTPPMLDSDGSFFLYSKLTVDKSRWQEGNVFSCSVMHEALHSHYTQKSLSLSPG

SEQ ID NO: 270 - protein, 329 aa, Artificial Sequence
  IgG1-IF10-CH1-Fc-charges   (Figure 92U)
ASTKGPSVFPLAPSSKSTSGGTAALGCLVKDYFPEPVTVSWNSGALESGVHTFPAVLQSSGLYSLSSVVTVPSSSLGTQTYICNVNHKPSDTEVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSEEEMTKNQVSLTCLVKGFYPSDIAVEWESNGQPENNYKTTPPVLDSDGSFFLYSKLTVDKSRWQQGNVFSCSVMHEALHNHYTQKSLSLEPG

SEQ ID NO: 271 - protein, 329 aa, Artificial Sequence
  IgG1-IF16-CH1-Fc-charges   (Figure 92U)
ASTKGPSVFPLAPSSKSTSGGTAALGCLVKDYFPEPVTVSWNSGALESGVHTFPAVLQSSGLYSLSSVVTVPSSSLGTQTYICNVNHKPSDTEVDKKVEPKSCDKTHTCPPCPAPELLGGPSVFLFPPKPKDTLMISRTPEVTCVVVDVSHEDPEVEFNWYVDGVEVHNAKTKPREEQYNSTYRVVSVLTVLHQDWLNGKEYKCKVSNKALPAPIEKTISKAKGQPREPQVYTLPPSEEEMEKNEVSLTCLVKGFYPSDIAVEWESNGQPEENYKTTPPVLDSDGSFFLYSKLTVDKSRWQQGNVFSCSVMHEALHNHYTQKSLSLEPG

SEQ ID NO: 272 - protein, 329 aa, Artificial Sequence
  IgG1-IF10-ISO-CH1-Fc-charges   (Figure 92U)
ASTKGPSVFPLAPSSKSTSGGTAALGCLVKDYFPEPVTVSWNSGALTSGVHTFPAVLQSSGLYSLSSVVTVPSSSLGTQTYICNVNHKPSDTEVDKKVEPKSCDKTHTCPPCPAPELLGGPSVFLFPPKPKDTLMISRTPEVTCVVVDVSHEDPEVQFNWYVDGVEVHNAKTKPREEQYNSTYRVVSVLTVLHQDWLNGKEYKCKVSNKALPAPIEKTISKAKGQPREPQVYTLPPSEEEMTKNQVSLTCLVKGFYPSDIAVEWESSGQPENNYNTTPPMLDSDGSFFLYSKLTVDKSRWQEGNVFSCSVMHEALHNHYTQKSLSLEPG

SEQ ID NO: 273 - protein, 329 aa, Artificial Sequence
  IgG1-IF16-ISO-CH1-Fc-charges   (Figure 92U)
ASTKGPSVFPLAPSSKSTSGGTAALGCLVKDYFPEPVTVSWNSGALESGVHTFPAVLQSSGLYSLSSVVTVPSSSLGTQTYICNVNHKPSDTEVDKKVEPKSCDKTHTCPPCPAPELLGGPSVFLFPPKPKDTLMISRTPEVTCVVVDVSHEDPEVEFNWYVDGVEVHNAKTKPREEQYNSTYRVVSVLTVLHQDWLNGKEYKCKVSNKALPAPIEKTISKAKGQPREPQVYTLPPSEEEMEKNEVSLTCLVKGFYPSDIAVEWESSGQPENNYNTTPPMLDSDGSFFLYSKLTVDKSRWEEGNVFSCSVMHEALHNHYTQKSLSLEPG

SEQ ID NO: 274 - protein, 329 aa, Artificial Sequence
  IgG1-pI-ISO(-)   (Figure 92V)
ASTKGPSVFPLAPSSKSTSGGTAALGCLVKDYFPEPVTVSWNSGALTSGVHTFPAVLQSSGLYSLSSVVTVPSSSLGTQTYTCNVDHKPSNTKVDKKVEPKSCDKTHTCPPCPAPELLGGPSVFLFPPKPKDTLMISRTPEVTCVVVDVSHEDPEVQFNWYVDGVEVHNAKTKPREEQYNSTYRVVSVLTVLHQDWLNGKEYKCKVSNKALPAPIEKTISKAKGQPREPQVYTLPPSQEEMTKNQVSLTCLVKGFYPSDIAVEWESSGQPENNYNTTPPMLDSDGSFFLYSKLTVDKSRWQEGNVFSCSVMHEALHNHYTQKSLSLSPG

SEQ ID NO: 275 - protein, 330 aa, Artificial Sequence
  IgG1-pI-ISO(+RR)  (Figure 92V)
ASTKGPSVFPLAPSSKSTSGGTAALGCLVKDYFPEPVTVSWNSGALTSGVHTFPAVLQSSGLYSLSSVVTVPSSSLGTKTYTCNVNHKPSNTKVDKKVERKSCDKTHTCPRCPAPELLGGPSVFLFPPKPKDTLMISRTPEVTCVVVDVSHEDPEVKFKWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 276 - protein, 330 aa, Artificial Sequence
  IgG1-pI-ISO(+)  (Figure 92V)
ASTKGPSVFPLAPSSKSTSGGTAALGCLVKDYFPEPVTVSWNSGALTSGVHTFPAVLQSSGLYSLSSVVTVPSSSLGTKTYTCNVNHKPSNTKVDKKVEPKSCDKTHTCPPCPAPELLGGPSVFLFPPKPKDTLMISRTPEVTCVVVDVSHEDPEVKFKWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 277 - protein, 107 aa, Artificial Sequence [sequence omitted]

SEQ ID NO: 278 - protein, 107 aa, Artificial Sequence [sequence omitted]

SEQ ID NO: 279 - protein, 107 aa, Artificial Sequence [sequence omitted]

SEQ ID NO: 280 - protein, 107 aa, Artificial Sequence [sequence omitted]

SEQ ID NO: 281 - protein, 107 aa, Artificial Sequence [sequence omitted]

SEQ ID NO: 282 - protein, 107 aa, Artificial Sequence [sequence omitted]

SEQ ID NO: 283 - protein, 107 aa, Artificial Sequence; identical to SEQ ID NO: 8
  Ck-pI(6)  (Figure 93A)

SEQ ID NO: 284 - protein, 107 aa, Artificial Sequence; identical to SEQ ID NO: 8
  Ck-pI(6) (B)  (Figure 93A)

SEQ ID NO: 285 - protein, 107 aa, Artificial Sequence; identical to SEQ ID NO: 8
  Ck-pI(6) (C)  (Figure 93A)

SEQ ID NO: 286 - protein, 107 aa, Artificial Sequence; identical to SEQ ID NO: 8
  Ck-pI(6) (D)  (Figure 93A)

SEQ ID NO: 287 - protein, 107 aa, Artificial Sequence
  Ck-pI(3)  (Figure 93A)
RTVAAPSVFIFPPSDEQLESGTASVVCLLNNFYPREAEVQWKVDNALQSGNSQESVTEQDSEDSTYSLSSTLTLSKADYEKHKVYACEVTHQGLSSPVTKSFNRGEC

SEQ ID NO: 288 - protein, 111 aa, Artificial Sequence
  Ck-pI(6-DEDE)  (Figure 93A)
RTVAAPSVFIFPPSDEQLESGTASVVCLLNNFYPREAEVQWKVDDALQEGNSQESVTEQDSEDSTYSLSSTLTLSKADYEKHKVYACEVTHQGLESPVTKSFNRGECDEDE

SEQ ID NO: 289 - protein, 107 aa, Artificial Sequence; identical to SEQ ID NO: 287
  Ck-pI(3) (B)  (Figure 93B)

SEQ ID NO: 290 - protein, 107 aa, Artificial Sequence; identical to SEQ ID NO: 8
  Ck-pI(6) (E)   (Figure 93B)

SEQ ID NO: 291 - protein, 111 aa, Artificial Sequence; identical to SEQ ID NO: 288
  Ck-pI(6-DEDE) (B)   (Figure 93B)

SEQ ID NO: 292 - protein, 107 aa, Artificial Sequence [sequence omitted]

SEQ ID NO: 293 - protein, 107 aa, Artificial Sequence [sequence omitted]

SEQ ID NO: 294 - protein, 107 aa, Artificial Sequence [sequence omitted]

SEQ ID NO: 295 - protein, 107 aa, Artificial Sequence; identical to SEQ ID NO: 287
  Ck-pI(3) (C)   (Figure 93B)

SEQ ID NO: 296 - protein, 107 aa, Artificial Sequence; identical to SEQ ID NO: 8
  Ck-pI(6) (F)   (Figure 93B)

SEQ ID NO: 297 - protein, 111 aa, Artificial Sequence; identical to SEQ ID NO: 288
  Ck-pI(6-DEDE) (C)   (Figure 93B)

SEQ ID NO: 298 - protein, 107 aa, Artificial Sequence [sequence omitted]

SEQ ID NO: 299 - protein, 107 aa, Artificial Sequence; identical to SEQ ID NO: 287
  Ck-pI(3) (d)   (Figure 93B)

SEQ ID NO: 300 - protein, 107 aa, Artificial Sequence; identical to SEQ ID NO: 8
  Ck-pI(6) (G)   (Figure 93B)

SEQ ID NO: 301 - protein, 111 aa, Artificial Sequence; identical to SEQ ID NO: 288
  Ck-pI(6-DEDE) (D)   (Figure 93B)

SEQ ID NO: 302 - protein, 107 aa, Artificial Sequence
  Ck-pI(4)   (Figure 93B)
RTVAAPSVFIFPPSDEQLESGTASVVCLLNNFYPREAEVQWKVDNALQSGNSQESVTEQDSEDSTYSLSSTLTLSKADYEKHKVYACEVTHQGLSSPVTESFNRGEC

SEQ ID NO: 303 - protein, 107 aa, Artificial Sequence; identical to SEQ ID NO: 302
  Ck-pI(4) (B)   (Figure 93B)

SEQ ID NO: 304 - protein, 107 aa, Artificial Sequence; identical to SEQ ID NO: 302
  Ck-pI(4) (C)   (Figure 93C)

SEQ ID NO: 305 - protein, 107 aa, Artificial Sequence; identical to SEQ ID NO: 302
  Ck-pI(4) (D)   (Figure 93C)

SEQ ID NO: 306 - protein, 107 aa, Artificial Sequence
  CK-N152D S156E S202E   (Figure 93C)
RTVAAPSVFIFPPSDEQLKSGTASVVCLLNNFYPREAKVQWKVDDALQEGNSQESVTEQDSKDSTYSLSSTLTLSKADYEKHKVYACEVTHQGLESPVTKSFNRGEC

SEQ ID NO: 307 - protein, 107 aa, Artificial Sequence; identical to SEQ ID NO: 59
  CK-K126Q K145Q K169Q   (Figure 93C)

SEQ ID NO: 308 - protein, 107 aa, Artificial Sequence; identical to SEQ ID NO: 287
  CK-K126E K145E K169E   (Figure 93C)

SEQ ID NO: 309 - protein, 107 aa, Artificial Sequence [sequence omitted]

SEQ ID NO: 310 - protein, 107 aa, Artificial Sequence [sequence omitted]

SEQ ID NO: 311 - protein, 107 aa, Artificial Sequence [sequence omitted]

SEQ ID NO: 312 - protein, 107 aa, Artificial Sequence [sequence omitted]

SEQ ID NO: 313 - protein, 107 aa, Artificial Sequence; identical to SEQ ID NO: 302
  Ck-pI(4) (E)   (Figure 93C)

SEQ ID NO: 314 - protein, 107 aa, Artificial Sequence; identical to SEQ ID NO: 302
  Ck-pI(4) (F)   (Figure 93C)

SEQ ID NO: 315 - protein, 107 aa, Artificial Sequence; identical to SEQ ID NO: 302
  Ck-pI(4) (G)   (Figure 93C)

SEQ ID NO: 316 - protein, 107 aa, Artificial Sequence; identical to SEQ ID NO: 302
  Ck-pI(4) (H)   (Figure 93C)

SEQ ID NO: 317 - protein, 107 aa, Artificial Sequence [sequence omitted]

SEQ ID NO: 318 - protein, 107 aa, Artificial Sequence [sequence omitted]

SEQ ID NO: 319 - protein, 107 aa, Artificial Sequence [sequence omitted]

SEQ ID NO: 320 - protein, 107 aa, Artificial Sequence [sequence omitted]

SEQ ID NO: 321 - protein, 107 aa, Artificial Sequence [sequence omitted]

SEQ ID NO: 322 - protein, 107 aa, Artificial Sequence [sequence omitted]

SEQ ID NO: 323 - protein, 107 aa, Artificial Sequence [sequence omitted]

SEQ ID NO: 324 - protein, 107 aa, Artificial Sequence [sequence omitted]

SEQ ID NO: 325 - protein, 107 aa, Artificial Sequence [sequence omitted]

SEQ ID NO: 326 - protein, 107 aa, Artificial Sequence [sequence omitted]

SEQ ID NO: 327 - protein, 107 aa, Artificial Sequence [sequence omitted]

SEQ ID NO: 328 - protein, 107 aa, Artificial Sequence [sequence omitted]

SEQ ID NO: 329 - protein, 107 aa, Artificial Sequence [sequence omitted]

SEQ ID NO: 330 - protein, 107 aa, Artificial Sequence [sequence omitted]

SEQ ID NO: 331 - protein, 107 aa, Artificial Sequence [sequence omitted]

SEQ ID NO: 332 - protein, 107 aa, Artificial Sequence [sequence omitted]

SEQ ID NO: 333 - protein, 107 aa, Artificial Sequence [sequence omitted]

SEQ ID NO: 334 - protein, 107 aa, Artificial Sequence [sequence omitted]

SEQ ID NO: 335 - protein, 107 aa, Artificial Sequence [sequence omitted]

SEQ ID NO: 336 - protein, 107 aa, Artificial Sequence [sequence omitted]

SEQ ID NO: 337 - protein, 107 aa, Artificial Sequence [sequence omitted]

SEQ ID NO: 338 - protein, 107 aa, Artificial Sequence [sequence omitted]

SEQ ID NO: 339 - protein, 107 aa, Artificial Sequence [sequence omitted]

SEQ ID NO: 340 - protein, 107 aa, Artificial Sequence [sequence omitted]

SEQ ID NO: 341 - protein, 107 aa, Artificial Sequence [sequence omitted]

SEQ ID NO: 342 - protein, 107 aa, Artificial Sequence [sequence omitted]

SEQ ID NO: 343 - protein, 107 aa, Artificial Sequence; identical to SEQ ID NO: 30
  Ck-Iso(3)  (Figure 93E)

SEQ ID NO: 344 - protein, 107 aa, Artificial Sequence
  Ck-Iso(4)  (Figure 93E)
QTVAAPSVFIFPPSDEQLQSGTASVVCLLNNFYPREATVQWKVDNALQSGNSQESVTEQDSKDSTYSLSSTLTLSKADYEKHKVYACEVTHEGLSSPVTKSFNRGEC

SEQ ID NO: 345 - protein, 107 aa, Artificial Sequence; identical to SEQ ID NO: 32
  Ck-Iso(5)  (Figure 93E)

SEQ ID NO: 346 - protein, 107 aa, Artificial Sequence; identical to SEQ ID NO: 33
  Ck-Iso(6)  (Figure 93E)

SEQ ID NO: 347 - protein, 107 aa, Artificial Sequence [sequence omitted]

SEQ ID NO: 348 - protein, 107 aa, Artificial Sequence [sequence omitted]

SEQ ID NO: 349 - protein, 107 aa, Artificial Sequence [sequence omitted]

SEQ ID NO: 350 - protein, 107 aa, Artificial Sequence [sequence omitted]

SEQ ID NO: 351 - protein, 107 aa, Artificial Sequence [sequence omitted]

SEQ ID NO: 352 - protein, 107 aa, Artificial Sequence [sequence omitted]

SEQ ID NO: 353 - protein, 107 aa, Artificial Sequence [sequence omitted]

SEQ ID NO: 354 - protein, 107 aa, Artificial Sequence [sequence omitted]

SEQ ID NO: 355 - protein, 107 aa, Artificial Sequence [sequence omitted]

SEQ ID NO: 356 - protein, 107 aa, Artificial Sequence [sequence omitted]

SEQ ID NO: 357 - protein, 107 aa, Artificial Sequence [sequence omitted]

SEQ ID NO: 358 - protein, 107 aa, Artificial Sequence [sequence omitted]

SEQ ID NO: 359 - protein, 107 aa, Artificial Sequence [sequence omitted]

SEQ ID NO: 360 - protein, 107 aa, Artificial Sequence [sequence omitted]

SEQ ID NO: 361 - protein, 107 aa, Artificial Sequence; identical to SEQ ID NO: 302
  Ck-pI(4) (DD)  (Figure 93F)

SEQ ID NO: 362 - protein, 107 aa, Artificial Sequence; identical to SEQ ID NO: 302
  Ck-pI(4) (EE)  (Figure 93F)

SEQ ID NO: 363 - protein, 107 aa, Artificial Sequence [sequence omitted]

SEQ ID NO: 364 - protein, 107 aa, Artificial Sequence; identical to SEQ ID NO: 30
  Ck-Iso(3) (B)  (Figure 93G)

SEQ ID NO: 365 - protein, 107 aa, Artificial Sequence; identical to SEQ ID NO: 344
  Ck-Iso(4) (B)  (Figure 93G)

SEQ ID NO: 366 - protein, 107 aa, Artificial Sequence; identical to SEQ ID NO: 32
  Ck-Iso(5) (C)  (Figure 93G)

SEQ ID NO: 367 - protein, 107 aa, Artificial Sequence; identical to SEQ ID NO: 30
  Ck-Iso(3) C)  (Figure 93G)

SEQ ID NO: 368 - protein, 107 aa, Artificial Sequence; identical to SEQ ID NO: 344
  Ck-Iso(4) (C)  (Figure 93G)

SEQ ID NO: 369 - protein, 107 aa, Artificial Sequence; identical to SEQ ID NO: 32
  Ck-Iso(5) (C)  (Figure 93G)

SEQ ID NO: 370 - protein, 107 aa, Artificial Sequence; identical to SEQ ID NO: 30
  Ck-Iso(3) (D)  (Figure 93G)

SEQ ID NO: 371 - protein, 107 aa, Artificial Sequence; identical to SEQ ID NO: 344
  Ck-Iso(4) (D)  (Figure 93G)

SEQ ID NO: 372 - protein, 107 aa, Artificial Sequence; identical to SEQ ID NO: 32
  Ck-Iso(5) (D)  (Figure 93G)

SEQ ID NO: 373 - protein, 107 aa, Artificial Sequence; identical to SEQ ID NO: 302
  Ck-pI(4) (GG)  (Figure 93G)

SEQ ID NO: 374 - protein, 107 aa, Artificial Sequence; identical to SEQ ID NO: 32
  Ck-Iso(5) (E)  (Figure 93G)

SEQ ID NO: 375 - protein, 107 aa, Artificial Sequence; identical to SEQ ID NO: 32
  Ck-Iso(5) (F)  (Figure 93G)

SEQ ID NO: 376 - protein, 107 aa, Artificial Sequence
  CK-v8  (Figure 93G)
RTVAAPSVFIFPPSDEQLESGTASVVCLLNNFYPREAEVQWKVDDALQSGNSQESVTEQDSEDSTYSLSSTLTLSKADYEKHKVYACEVTHQGLESPVTKSFNRGEC

SEQ ID NO: 377 - protein, 107 aa, Artificial Sequence
  CK-v28  (Figure 93G)
RTVAAPSVFIFPPSDEQLESGTASVVCLLNNFYPREAEVQWKVDNALQEGNSQESVTEQDSEDSTYSLSSTLTLSKADYEKHKVYACEVTHQGLESPVTKSFNRGEC

SEQ ID NO: 378 - protein, 107 aa, Artificial Sequence
  CK-v23  (Figure 93G)
RTVAAPSVFIFPPSDEQLESGTASVVCLLNNFYPREAEVQWKVDNALQSGNSQESVTEQDSEDSTYSLSSTLTLSKADYEKHKVYACEVTHQGLESPVTKSFNRGEC

SEQ ID NO: 379 - protein, 107 aa, Artificial Sequence
  CK-v12  (Figure 93H)
RTVAAPSVFIFPPSDEQLKSGTASVVCLLNNFYPREAEVQWKVDNALQSGNSQESVTEQDSEDSTYSLSSTLTLSKADYEKHKVYACEVTHQGLSSPVTKSFNRGEC

SEQ ID NO: 380 - protein, 107 aa, Artificial Sequence; identical to SEQ ID NO: 376
  CK-v8 (B)  (Figure 93H)

SEQ ID NO: 381 - protein, 107 aa, Artificial Sequence; identical to SEQ ID NO: 377
  CK-v28 (B)  (Figure 93H)

SEQ ID NO: 382 - protein, 107 aa, Artificial Sequence; identical to SEQ ID NO: 378
  CK-v23 (B)  (Figure 93H)

SEQ ID NO: 383 - protein, 107 aa, Artificial Sequence; identical to SEQ ID NO: 379
  CK-v12 (B)  (Figure 93H)

SEQ ID NO: 384 - protein, 107 aa, Artificial Sequence; identical to SEQ ID NO: 376
  CK-v8 (C)  (Figure 93H)

SEQ ID NO: 385 - protein, 107 aa, Artificial Sequence; identical to SEQ ID NO: 377
  CK-v28 (C)  (Figure 93H)

SEQ ID NO: 386 - protein, 107 aa, Artificial Sequence; identical to SEQ ID NO: 378
  CK-v23 (C)  (Figure 93H)

SEQ ID NO: 387 - protein, 107 aa, Artificial Sequence; identical to SEQ ID NO: 379
  CK-v12 (C)  (Figure 93H)

SEQ ID NO: 388 - protein, 107 aa, Artificial Sequence; identical to SEQ ID NO: 378
  CK-v23 (D)  (Figure 93H)

SEQ ID NO: 389 - protein, 107 aa, Artificial Sequence; identical to SEQ ID NO: 379
  CK-v12 (D)  (Figure 93H)

SEQ ID NO: 390 - protein, 107 aa, Artificial Sequence; identical to SEQ ID NO: 379
  CK-v12 (E)  (Figure 93H)

SEQ ID NO: 391 - protein, 107 aa, Artificial Sequence; identical to SEQ ID NO: 378
  CK-v23 (E)  (Figure 93H)

SEQ ID NO: 392 - protein, 107 aa, Artificial Sequence; identical to SEQ ID NO: 378
  CK-v23 (F)  (Figure 93H)

SEQ ID NO: 393 - protein, 107 aa, Artificial Sequence; identical to SEQ ID NO: 379
  CK-v12 (F)  (Figure 93H)

SEQ ID NO: 394 - protein, 107 aa, Artificial Sequence; identical to SEQ ID NO: 378
  CK-v23 (G)  (Figure 93I)

SEQ ID NO: 395 - protein, 107 aa, Artificial Sequence; identical to SEQ ID NO: 379
  CK-v12 (G)   (Figure 93I)

SEQ ID NO: 396 - protein, 107 aa, Artificial Sequence; identical to SEQ ID NO: 379
  CK-v12 (H)   (Figure 93I)

SEQ ID NO: 397 - protein, 107 aa, Artificial Sequence; identical to SEQ ID NO: 378
  CK-v23 (H)   (Figure 93I)

SEQ ID NO: 398 - protein, 107 aa, Artificial Sequence; identical to SEQ ID NO: 379
  CK-v12 (I)   (Figure 93I)

SEQ ID NO: 399 - protein, 107 aa, Artificial Sequence; identical to SEQ ID NO: 378
  CK-v23 (I)   (Figure 93I)

SEQ ID NO: 400 - protein, 107 aa, Artificial Sequence [sequence omitted]

SEQ ID NO: 401 - protein, 107 aa, Artificial Sequence [sequence omitted]

SEQ ID NO: 402 - protein, 107 aa, Artificial Sequence [sequence omitted]

SEQ ID NO: 403 - protein, 333 aa, Artificial Sequence
  Variant heavy chain constant domain  (Spec. pg. 7)
  MISC_FEATURE (2)..(2): X may be Serine or Glutamic Acid
  MISC_FEATURE (14)..(14): X may be Serine or Cysteine
  MISC_FEATURE (16)..(16): X may be Lysine, Arginine or Glutamic Acid
  MISC_FEATURE (20)..(20): X may be Glycine or Glutamic Acid
  MISC_FEATURE (21)..(21): X may be Glycine or Serine
  MISC_FEATURE (47)..(47): X may be Threonine or Glutamic Acid
  MISC_FEATURE (75)..(75): X may be Serine or Asparagine
  MISC_FEATURE (76)..(76): X may be Leucine or Phenylalanine
  MISC_FEATURE (79)..(79): X may be Glutamine or Lysine
  MISC_FEATURE (82)..(82): X may be Isoleucine or Threonine
  MISC_FEATURE (86)..(86): X may be Asparagine or Aspartic Acid
  MISC_FEATURE (88)..(88): X may be Lysine, Glutamic Acid or Glutamine
  MISC_FEATURE (91)..(91): X may be Asparagine or Aspartic Acid
  MISC_FEATURE (93)..(93): X may be Lysine, Glutamic Acid or Glutamine
  MISC_FEATURE (97)..(97): X may be Lysine or Threonine
  MISC_FEATURE (100)..(100): X may beProline or Arginine
  MISC_FEATURE (102)..(102): X may be Serine or Cysteine
  MISC_FEATURE (104)..(104): X may be Aspartic Acid or a deletion
  MISC_FEATURE (105)..(105): X may be Lysine, Valine or Threonine
  MISC_FEATURE (106)..(106): X may be Threonine or a deletion
  MISC_FEATURE (107)..(107): X may be Histidine or Glutamic Acid
  MISC_FEATURE (108)..(108): X may be Threonine or a deletion
  MISC_FEATURE (116)..(116): X may be Glutamic Acid or Proline
  MISC_FEATURE (117)..(117): X may be Leucine or Valine
  MISC_FEATURE (118)..(118): X may be Leucine or Alanine or a deletion
  MISC_FEATURE (119)..(119): X may be Glycine or Alanine or a deletion
  MISC_FEATURE (157)..(157): X may be Lysine, Glutamine or Glutamic Acid
  MISC_FEATURE (179)..(179): X may be Tyrosine or Phenylalanine
  MISC_FEATURE (183)..(183): X may be Tyrosine or Phenylalanine
  MISC_FEATURE (192)..(192): X may be Leucine or Valine
  MISC_FEATURE (203)..(203): X may be Lysine or Glutamic Acid
  MISC_FEATURE (205)..(205): X may be Lysine or Glutamic Acid
  MISC_FEATURE (209)..(209): X may be Lysine or Glutamic Acid
  MISC_FEATURE (210)..(210): X may be Alanine or Glycine
  MISC_FEATURE (217)..(217): X may be Lysine or Glutamic Acid
  MISC_FEATURE (222)..(222): X may be Alanine or Threonine
  MISC_FEATURE (238)..(238): X may be Arginine, Glutamine or Glutamic Acid
  MISC_FEATURE (267)..(267): X may be Asparagine or Serine
  MISC_FEATURE (275)..(275): X may be Lysine, Asparagine or Glutamic Acid
  MISC_FEATURE (280)..(280): X may be Valine or Methionine
  MISC_FEATURE (302)..(302): X may be Glutamine or Glutamic Acid
  MISC_FEATURE (311)..(311): X may be Methionine or Leucine
  MISC_FEATURE (317)..(317): X may be Asparagine or Serine
  MISC_FEATURE (330)..(330): X may be Lysine and a deletion
  MISC_FEATURE (331)..(331): X may be Glutamic Acid or absent
  MISC_FEATURE (332)..(332): X may be Aspartic Acid or absent
  MISC_FEATURE (333)..(333): X may be Glutamic Acid or absent
AXTKGPSVFPLAPXSXSTSXXTAALGCLVKDYFPEPVTVSWNSGALXSGVHTFPAVLQSSGLYSLSSVVTVPSSXXGTXTYXCNVXHXPSXTXVDKXVEXKXCXXXXXCPPCPAPXXXXGPSVFLFPPKPKDTLMISRTPEVTCVVVDVSHEDPEVXFNWYVDGVEVHNAKTKPREEQXNSTXRVVSVLTVXHQDWLNGKEYXCXVSNXXLPAPIEXTISKXKGQPREPQVYTLPPSXEEMTKNQVSLTCLVKGFYPSDIAVEWESXGQPENNYXTTPPXLDSDGSFFLYSKLTVDKSRWQXGNVFSCSVXHEALHXHYTQKSLSLSPGXXXX

SEQ ID NO: 404 - protein, 111 aa, Artificial Sequence
  Variant light chain constant domain  (Spec. pg. 9)
  MISC_FEATURE (1)..(1): X may be Arginine or Glutamine
  MISC_FEATURE (17)..(17): X may be Glutamine or Glutamic Acid
  MISC_FEATURE (19)..(19): X may be Lysine, Glutamic Acid or Glutamine
  MISC_FEATURE (31)..(31): X may be Asparagine or Aspartic Acid
  MISC_FEATURE (38)..(38): X may be Lysine, Glutamic Acid, Glutamine or Threonine
  MISC_FEATURE (45)..(45): X may be Asparagine or Aspartic Acid
  MISC_FEATURE (49)..(49): X may be Serine or Glutamic Acid
  MISC_FEATURE (62)..(62): X may be Lysine, Glutamic Acid or Glutamine
  MISC_FEATURE (92)..(92): X may be Glutamine or Glutamic Acid
  MISC_FEATURE (95)..(95): X may be Serine or Glutamic Acid
  MISC_FEATURE (100)..(100): X may be Lysine or Glutamic Acid
  MISC_FEATURE (107)..(107): X may be Cysteine
  MISC_FEATURE (108)..(108): X may be Aspartic Acid or absent
  MISC_FEATURE (109)..(109): X may be Glutamic Acid or absent
  MISC_FEATURE (110)..(110): X imay be Aspartic Acid or absent
  MISC_FEATURE (111)..(111): X may be Glutamic Acid or absent
XTVAAPSVFIFPPSDEXLXSGTASVVCLLNXFYPREAXVQWKVDXALQXGNSQESVTEQDSXDSTYSLSSTLTLSKADYEKHKVYACEVTHXGLXSPVTXSFNRGEXXXXX

SEQ ID NO: 405 - protein, 329 aa, Artificial Sequence
  lgG1-WT (Figure 19)
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRWSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 406 - protein, 325 aa, Artificial Sequence
  lgG2-WT (Figure 19)
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCWVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 407 - protein, 122 aa, Artificial Sequence
  Bevacizumab VH (Figure 19)
EVQLVESGGGLVQPGGSLRLSCAASGYTFTNYGMNWVRQAPGKGLEWVGWINTYTGEPTYAADFKRRFTFSLDTSKSTAYLQMNSLRAEDTAWYCAKYPHYYGSSHWYFDVWGQGTLVTVSS

SEQ ID NO: 408 - protein, 106 aa, Artificial Sequence; identical to SEQ ID NO: 1
  CK-WT (Figure 20)

SEQ ID NO: 409 - protein, 106 aa, Artificial Sequence
  CK-pl(6) (Figure 20)
RTVAAPSVFIFPPSDEQLESGTASWCLLNNFYPREAEVQWKVDDALQEGNSQESVTEQDSEDSTYSLSSTLTLSKADYEKHKVYACEVTHQGLESPVTKSFNRGEC

SEQ ID NO: 410 - protein, 107 aa, Artificial Sequence [sequence omitted]

SEQ ID NO: 411 - protein, 104 aa, Artificial Sequence
  IgG1 (Figure 2)
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKRVEPKSC

SEQ ID NO: 412 - protein, 103 aa, Artificial Sequence
  IgG2 (Figure 2)
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCC

SEQ ID NO: 413 - protein, 206 aa, Artificial Sequence
  IgG3 (Figure 2)
ASTKGPSVFPLAPCSRSTSGGTAALGCLVKDYFPEPVTVSWNSGALTSGVHTFPAVLQSSGLYSLSSVVTVPSSSLGTQTYTCNVNHKPSNTKVDKRVELKTPASTKGPSVFPLAPCSRSTSGGTAALGCLVKDYFPEPVTVSWNSGALTSGVHTFPAVLQSSGLYSLSSVVTVPSSSLGTQTYTCNVNHKPSNTKVDKRVELKTP

SEQ ID NO: 414 - protein, 206 aa, Artificial Sequence
  IgG4 (Figure 2)
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYG

SEQ ID NO: 415 - protein, 107 aa, Artificial Sequence [sequence omitted]

SEQ ID NO: 416 - protein, 16 aa, Artificial Sequence
  IgG1  (Figure 25)
DKTHTCPPCPAPELLG

SEQ ID NO: 417 - protein, 16 aa, Artificial Sequence
  pI-Iso3  (Figure 25)
DTTHTCPPCPAPELLG

SEQ ID NO: 418 - protein, 329 aa, Artificial Sequence; identical to SEQ ID NO: 184
  pl-iso3  (Figure 24)

SEQ ID NO: 419 - protein, 334 aa, Artificial Sequence
  IgG1  (Figure 24)
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKRVEPKSCDKTHTCPPCPAPELLGGPSVFLFPPKPKDTLMISRTPEVTCVVVDVSHEDPEVKFNWYVDCVEVHNAKTKPREEQYNSTYRVVSVLTVLHQDWLNGKEYKCKVSNKALPAPIEKTISKAKGQPREPQVYTLPPSRDELLMTKNQVSLTCLVKGFYPSDIAVEWESNGQPENNYKTTPPVLDSDGSFFLYSKLTVDKSRWQQGNVFSCSVMHEAGLHNHYTQKSLSLSPGK

SEQ ID NO: 420 - protein, 327 aa, Artificial Sequence
  IgG2  (Figure 24)
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDCVMEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 421 - protein, 377 aa, Artificial Sequence; identical to SEQ ID NO: 4
  IgG3 (Figure 24)

SEQ ID NO: 422 - protein, 326 aa, Artificial Sequence
  IgG4 (Figure 24)
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEEHNAKTKPREEQFNSTYRVVSVLTVLHQDWLNGKEYKCKVSNKGLPSSIEKTISKAKGQPREPVYTLPPSQEEMTKNQVSLTCLVKGFYPSDIAVEWESNGQPENNYKTTPPVLDSDGSFFLYSRLTVDKSRWQEGNVFSCSVNHEALHNHYTQKSLSLSLGK

SEQ ID NO: 423 - protein, 107 aa, Artificial Sequence; identical to SEQ ID NO: 302
  CK (Figure 27)

SEQ ID NO: 424 - protein, 24 aa, Artificial Sequence
  WT   (Figure 29)
KKRKKKRRKKKKKKKRRKKKKKRK

SEQ ID NO: 425 - protein, 330 aa, Artificial Sequence
  Chain H  (Figure 43)
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKAEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 426 - protein, 334 aa, Artificial Sequence
  IgG1  (Figure 17)
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDEELMTKNQVSLTCLVKGFYPSDIAVEWESNGQPENNYKTTPPVLDSDGSFFLYSKLTVDKSRWQQGNVFSCSVMHEAGLHNHYTQKSLSLSPGK

SEQ ID NO: 427 - protein, 327 aa, Artificial Sequence
  IgG2  (Figure 17)
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVMEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 428 - protein, 377 aa, Artificial Sequence; identical to SEQ ID NO: 4
  IgG3  (Figure 17)

SEQ ID NO: 429 - protein, 327 aa, Artificial Sequence
  IgG4  (Figure 17)
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLVPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 430 - protein, 330 aa, Artificial Sequence; identical to SEQ ID NO: 2
  IgG1  (Figure 52)

SEQ ID NO: 431 - protein, 326 aa, Artificial Sequence; identical to SEQ ID NO: 150
  IgG2  (Figure 52)

SEQ ID NO: 432 - protein, 332 aa, Artificial Sequence; identical to SEQ ID NO: 151
  IgG3  (Figure 52)

SEQ ID NO: 433 - protein, 327 aa, Artificial Sequence; identical to SEQ ID NO: 152
  IgG4  (Figure 52)

SEQ ID NO: 434 - protein, 329 aa, Artificial Sequence; identical to SEQ ID NO: 166
  PI-Iso1  (Figure 52)

SEQ ID NO: 435 - protein, 325 aa, Artificial Sequence; identical to SEQ ID NO: 19
  IgG-pI-Iso2  (Figure 52)

SEQ ID NO: 436 - protein, 329 aa, Artificial Sequence; identical to SEQ ID NO: 184
  IgG-pI-Iso3  (Figure 52)

SEQ ID NO: 437 - protein, 329 aa, Artificial Sequence; identical to SEQ ID NO: 262
  IgG1-pI-IF16-ISO  (Figure 52)

SEQ ID NO: 438 - protein, 329 aa, Artificial Sequence; identical to SEQ ID NO: 263
  IgG1-pI-IF10-ISO  (Figure 52)

SEQ ID NO: 439 - protein, 329 aa, Artificial Sequence; identical to SEQ ID NO: 274
  Iso(-)  (Figure 52)

SEQ ID NO: 440 - protein, 330 aa, Artificial Sequence; identical to SEQ ID NO: 275
  ISO(+RR)  (Figure 52)

SEQ ID NO: 441 - protein, 330 aa, Artificial Sequence; identical to SEQ ID NO: 276
  ISO(+)  (Figure 52)

SEQ ID NO: 442 - protein, 107 aa, Artificial Sequence
  Chain L  (Figure 43)
RTVAAPSVFIFPPSDEQLKSGTASVVCLLNNFYPREAKVQWKVDNALQSGNSQESVTEQDSKDSTYSLSSTLTLSKADYEKHKVYACEVTHQGLRSPVTKSFNRGEC

The invention claimed is:

1. A composition comprising a heterodimeric polypeptide comprising:
   a) a first variant human IgG1 heavy chain constant region comprising amino acid modifications as compared to a human IgG1 heavy chain constant region according to SEQ ID NO: 2, wherein said modifications comprise Q196K, I199T, P217R, P228R, and N276K, according to the EU index as in Kabat; and
   b) a second variant human IgG1 heavy chain constant region comprising amino acid modifications as compared to a human IgG1 heavy chain constant region according to SEQ ID NO: 2, wherein said modifications comprise N203D, K274Q, R355Q, Q419E, and K447del, according to the EU index as in Kabat,
   and wherein said first variant human IgG1 heavy chain constant region and said second variant human IgG1 heavy chain constant region each possess at least 95% sequence identity to SEQ ID NO: 2.

2. A nucleic acid composition comprising a first nucleic acid encoding said first variant human IgG1 heavy chain constant region of claim 1, and a second nucleic acid encoding said second variant human IgG1 heavy chain constant region of claim 1.

3. An isolated host cell comprising the nucleic acid composition of claim 2.

* * * * *